US008309701B2

(12) United States Patent
Drayna et al.

(10) Patent No.: US 8,309,701 B2
(45) Date of Patent: *Nov. 13, 2012

(54) VARIANTS OF HUMAN TASTE RECEPTOR GENES

(75) Inventors: Dennis Drayna, Potomac, MD (US); Un-Kyung Kim, Gaithersburg, MD (US)

(73) Assignee: The United States of America as represented by the Secrectary of the Department of Health and Human Services, Washington, DC (US)

( * ) Notice: Subject to any disclaimer, the term of this patent is extended or adjusted under 35 U.S.C. 154(b) by 102 days.

This patent is subject to a terminal disclaimer.

(21) Appl. No.: 12/534,505

(22) Filed: Aug. 3, 2009

(65) Prior Publication Data
US 2010/0035340 A1 Feb. 11, 2010

Related U.S. Application Data

(63) Continuation of application No. 10/561,487, filed as application No. PCT/US2004/019489 on Jun. 18, 2004, now Pat. No. 7,579,453.

(60) Provisional application No. 60/480,035, filed on Jun. 19, 2003.

(51) Int. Cl.
C07H 21/04 (2006.01)
C12N 15/63 (2006.01)
C12N 15/85 (2006.01)
C12Q 1/68 (2006.01)

(52) U.S. Cl. .................... 536/24.31; 536/23.1; 536/23.5; 435/320.1; 435/325; 435/6.1

(58) Field of Classification Search .................... None
See application file for complete search history.

(56) References Cited

U.S. PATENT DOCUMENTS

| 5,380,765 | A | 1/1995 | Hirsch | |
|---|---|---|---|---|
| 5,972,621 | A | 10/1999 | Tartaglia et al. | |
| 6,159,700 | A | 12/2000 | Aiyar et al. | |
| 6,383,778 | B1 | 5/2002 | Zuker et al. | |
| 6,521,747 | B2 | 2/2003 | Anastasio et al. | |
| 6,540,978 | B1 | 4/2003 | Margolskee et al. | |
| 6,558,910 | B2 | 5/2003 | Zuker et al. | |
| 7,579,453 | B2 * | 8/2009 | Drayna et al. | 536/24.31 |
| 2002/0048763 | A1 | 4/2002 | Penn et al. | |
| 2002/0094551 | A1 | 7/2002 | Adler | |
| 2002/0128433 | A1 | 9/2002 | Yao et al. | |
| 2002/0143151 | A1 | 10/2002 | Yao et al. | |
| 2003/0022278 | A1 | 1/2003 | Zuker et al. | |
| 2003/0143668 | A1 | 7/2003 | Suwa et al. | |
| 2003/0235833 | A1 | 12/2003 | Suwa et al. | |
| 2010/0248360 | A1 * | 9/2010 | Adler | 435/348 |
| 2011/0177085 | A1 * | 7/2011 | Bufe et al. | 424/139.1 |

FOREIGN PATENT DOCUMENTS

| CA | 2418130 | 2/2003 |
|---|---|---|
| EP | 1270724 | 1/2003 |
| WO | WO 99/06830 | 2/1999 |
| WO | WO 00/21985 | 4/2000 |
| WO | WO 00/38536 | 7/2000 |
| WO | WO 01/18050 | 3/2001 |
| WO | WO 01/66563 | 9/2001 |
| WO | WO 01/77676 | 10/2001 |
| WO | WO 02/16548 | 2/2002 |
| WO | WO 02/36622 | 5/2002 |
| WO | WO 02/068579 | 9/2002 |
| WO | WO 02/103005 | 12/2002 |
| WO | WO 03/006482 | 1/2003 |
| WO | WO 03/008627 | 1/2003 |
| WO | WO 2004/029087 | 4/2004 |

OTHER PUBLICATIONS

Bufe, et al (2002)The human TAS2R16 receptor mediates bitter taste in response to *beta*-glucopyranosides. Nature Genetics, 32: 397-401.*
Adler et al., "A Novel Family of Mammalian Taste Receptors," *Cell* 100:693-702 (2000).
Anne-Spence et al., "Estimating the Recombination frequency for the PTC-Kell linkage," *Hum. Genet.* 67:183-186 (1984).
Bradbury, "Taste Perception: Cracking the code," *PLoS Biology* 2(3):0295-0297 (2004).
Bufe et al., "The human TAS2R16 receptor mediates bitter taste in response to β-glucopyranosides," *Nature Genetics* 32:397-401 (2002).
Bufe et al., "The Molecular Basis of Individual Differences in Phenylthiocarbamide and Propylthiouracil Bitterness Perception," *Current Biol.* 15:322-327 (2005).
Bufe, "Dissertation zur Erlangung des Doktorgrades an der Universitat Potsdam: Identifizierung and Charakterisierung von Bitterezeptoren," http://www.pub.ub.uni-potsdam.de/2004/0013/bufe.pdf (May 2003).
Campbell et al., "Totipotency or multipotentiality of cultured cells: applications and progress," *Theriology* 47(1):63-72 (1997).
Chandrashekar et al., "T2Rs Function as Bitter Taste Receptors," *Cell* 100:703-711, (2000).
Conte et al., "Identification and characterization of human taste receptor genes belonging to the TAS2R family," *Cytogenet. Genome. Res.* 98:45-53 (2002).

(Continued)

*Primary Examiner* — Vanessa L. Ford
*Assistant Examiner* — Sandra Wegert
(74) *Attorney, Agent, or Firm* — Klarquist Sparkman, LLP

(57) ABSTRACT

Identified herein are different forms of bitter receptor genes that occur in different humans. These alleles are generated by numerous coding single nucleotide polymorphisms (cSNP's) that occur within the members of the T2R gene family. Some SNP's cause amino acid substitutions, while others introduce chain termination codons, rendering the allele non-functional. Differences in these genes are believed to have a large effect on those individuals' sense of bitter taste, such that these individuals perceive the taste of bitter substances differently than the rest of the population. The ability to assay this allelic information is useful in the development of flavorings and flavor enhancers, as it can be used to define large groups and populations who perceive bitter tastes differently. This in turn allows the taste preferences of these groups to be addressed at the molecular level for the first time.

18 Claims, 8 Drawing Sheets

OTHER PUBLICATIONS

Drayna, et al., "Genetic analysis of a complex trait in the Utah Genetic Reference Project: a major locus for PTC taste ability on chromosome 7q and a secondary locus on chromosome 16p," *Hum. Genet.* 112:567-572 (2003).

Gillis, "Genetics May Hold Clues to Smell, Taste," *Los Angeles Times* (Jun. 4, 2001).

Guo and Reed, "The genetics of phenylthiocarbamide perception," *Annals of Human Biology* 28(2):111-142 (2001).

Kaufman et al., "Transgenic analysis of a 100-kb human β-globin cluster-containing DNA fragment propagated as a bacterial artificial chromosome," *Blood* 94:3178-3184 (1999).

Kim et al., "Genetics of Human Taste Perception," *J. Dent. Res.* 83(6):448-453 (2004).

Kim et al., "Positional Cloning of the Human Quantitative Trait Locus Underlying Taste Sensitivity to Phenylthiocarbamide," *Science* 299:1221-1225 (2003).

Kim et al., "Worldwide Haplotype Diversity and Coding Sequence Variation at Human Bitter Taste Receptor Loci," *Human Mutation* 26(3):199-204 (2005).

Lipshutz et al., "High density synthetic oligonucleotide arrays," *Nature Genetics Suppl.* 21:20-24 (1999).

Matsunami et al., "A family of candidate taste receptors in human and mouse," *Nature* 404:601-604 (2000).

McLaughlin et al., "Gustducin is a taste-cell-specific G protein closely related to the transducins," *Nature* 357:563-569 (1992).

Miyajima et al., "Expression of murine and human granulocyte-macrophage colony-stimulating factors in *S. cerevisiae*: mutagenesis of the potential glycosylation sites," *EMBO J.* 5:1193-1197 (1986).

Offermanns and Simon, "Gα15 and Gα16 couple a wide variety of receptors to phospholipase C," *J. Biol. Chem.* 270:15175-15180 (1995).

Sainz et al., "Identification of a novel member of the T1R family of putative taste receptors," *J. Neurochem.* 77(3):896-903 (2001).

Shi et al, "Adaptive Diversification of Bitter Taste Receptor Genes in Mammalian Evolution," *Mol. Biol. Evol.* 20:805-814 (2003).

Takeda et al., "Identification of G protein-coupled receptor genes from the human genome sequence," *FEBS Letters* 520:97-101 (2002).

Tepper, "Genetics of Perception '98: 6-n-Propylthiouracil: A Genetic Marker for Taste, with Implications for Food Preference and Dietary Habits," *Am. J. Hum. Genet.* 63:1271-1276 (1998).

The Sanger Center, "Toward a complete human genome sequence," *Genome Research* 8:1097-1108 (1998).

Ueda et al., "Identification of coding single-nucleotide polymorphisms in human taste receptor genes involving bitter tasting," *BBRC* 285(1):147-151 (2001).

Vaidehi et al., "Prediction of structure and function of G protein-coupled receptors," *PNAS* 99:12622-12627 (2002).

Wang et al., "Rapid analysis of gene expression (RAGE) facilitates universal expression profiling," *Nucleic Acids Research* 27(23):4609-4618 (1999).

Wang et al., "Relaxation of selective constraint and loss of function in the evolution of human bitter taste receptor genes," *Human Molecular Genetics* 13(21):2671-2678 (2004).

Wigley et al., "Site-specific transgene insertion: an approach," *Repro. Fertil. Dev.* 6:585-588 (1994).

Wooding et al., "Independent evolution of bitter-taste sensitivity in humans and chimpanzees," *Nature* 440:930-934 (2006).

Wooding et al., "Natural Selection and Molecular Evolution in *PTC*, a Bitter-Taste Receptor Gene," *Am. J. Hum. Genet.* 74:637-646 (2004).

Wu et al., "Expression of bitter taste receptors of the T2R family in the gastrointestinal tract and enteroendocrine STC-1 cells," *PNAS* 99(4):2392-2397 (2002).

Zhang et al., "Coding of sweet, bitter, and umami tastes: different receptor cells sharing similar signaling pathways," *Cell* 112(3):293-301 (2003).

Zhao et al., "The receptors for mammalian sweet and umami taste," *Cell* 115(3):255-266 (2003).

XP-002317838; DBSNP Database Accession No. RS1204014; ss1724864, *NCBI* (Oct. 5, 2000) (4 pages).

XP-002317834; DBSNP Database Accession No. RS2233988; ss3802437, *NCBI* (Oct. 10, 2003) (4 pages).

XP-002317835; DBSNP Database Accession No. RS2233989; ss14763657, *NCBI* (Nov. 12, 2003) (3 pages).

XP-002317833; DBSNP Database Accession No. RS2692396; ss3802436, *NCBI* (Sep. 25, 2001) (3 pages).

XP-002317836; DBSNP Database Accession No. RS846664; ss1724862, *NCBI* (Oct. 5, 2000) (4 pages).

XP-002317837; DBSNP Database Accession No. RS860170; ss1724863, *NCBI* (Oct. 5, 2000) (4 pages).

XP-002317831; DBSNP Database Accession No. RS597468; ss769354, *NCBI* (Jul. 27, 2000) (4 pages).

XP-002302159; DBSNP Database Accession No. RS41469; ss2718533, *NCBI* (Jan. 2, 2001) (2 pages).

XP-002302158; DBSNP Database Accession No. RS2234233; ss3181754, *NCBI* (Jul. 19, 2001) (2 pages).

NCBI DNA Sequence: "*Homo sapiens* BAC clone RP11-707F14 from 7, complete sequence," Accession No. AC073647 (Jan. 31, 2004) (60 page).

NCBI DNA Sequence: "*Homo sapiens* PTC bitter taste receptor (PTC) gene, PTC-taster allele, complete cds," Accession No. AY258597 (Apr. 29, 2003) (2 pages).

NCBI DNA Sequence: "*Homo sapiens* taste receptor, type 2, member 38 (TAS2R38), mRNA," Accession No. NM_176817 (Feb. 5, 2006) (4 pages).

NCBI DNA Sequence: "*Homo sapiens* putative taste receptor T2R61," Accession No. AY114095 (Feb. 28, 2003) (2 pages).

NCBI DNA Sequence: "Novel G-protein coupled receptors," Accession No. BD144608 (Jan. 17, 2003) (2 pages).

NCBI DNA Sequence: "*Homo sapiens* PTC bitter taste receptor (PTC) gene," Accession No. AY258598 (Apr. 29, 2003) (2 pages).

XP-002318542; EBML Database Accession No. EM_PRO:AF494228, "*Homo sapiens* candidate taste receptor TAS2R44 gene, complete cds", *EBI* (Apr. 29, 2002) (2 pages).

XP-002318544; EBML Database Accession No. EM_PRO:AF494236, "*Homo sapiens* candidate taste receptor TAS2R49 gene, complete cds", *EBI* (Apr. 29, 2002) (2 pages).

XP-002318543; EBML Database Accession No. EM_PRO:AF494237, "*Homo sapiens* candidate taste receptor TAS2R43 gene, complete cds", *EBI* (Apr. 29, 2002) (2 pages).

XP-0023178832; Geneseq Database Accession No. GNS:AAD05499, "Human secreted protein-encoding gene 8 cDNA clone HBBBC71, Seq ID No. 18", *EBI* (Jul. 18, 2001) (4 pages).

\* cited by examiner

Figure 1A

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R1 | AF227129 | AC026787 | 900 | 299 | 48928 - 49827 (-) | rs2234233 | C/T | 128 | Pro/Leu (43) | * | |
| SEQ ID NO: 1/2 | | | | | | rs41469 | A/G | 332 | His/Arg (111) | 43 : 3 (0.93 : 0.07) | A/A (0) ; G/A (3) ; G/G (26) |
| | | | | | | rs2234232 | G/A | 422 | Cys/Tyr (141) | * | |
| | | | | | | rs2234233 | C/T | 616 | Arg/Trp (206) | * | |
| | | | | | | rs2234234 | C/T | 675 | Ser/Ser (225) | * | |
| | | | | | | rs2234235 | T/C | 850 | Leu/Leu (284) | * | |
| T2R3 | AF227130 | AC064979.1 | | 316 | 17576 - 18526 (+) | NEW | C/T | 349 | Pro/Ser (117) | 1 | |
| SEQ ID NO: 3/4 | | | 951 | | | rs2270009 | C/T | 807 | Gly/Gly (269) | 36 : 10 (0.78 : 0.22) | C/C (13) ; C/T (10) ; T/T (0) |
| | | | | | | NEW | C/T | 852 | Leu/Leu (284) | 1 | |
| T2R4 | AF227131 | AC064979.1 | 900 | 299 | 31936 - 31835 (+) | rs2233995 | G/A | 8 | Arg/Gln (3) | 1 | |
| SEQ ID NO: 5/6 | | | | | | rs2233996 | G/C | 9 | Arg/Arg (3) | 2 | |
| | | | | | | rs2233997 | A/C | 17 | Tyr/Ser (6) | * | |
| | | | | | | rs2233998 | T/C | 20 | Phe/Ser (7) | 31 : 7 (0.82 : 0.18) | T/T (12) ; T/C (7) ; C/C (0) |
| | | | | | | rs2233999 | T/A | 186 | Phe/Leu (62) | 2 (only R seq) | |
| | | | | | | rs2234000 | C/T | 221 | Thr/Met (74) | * | |
| | | | | | | rs2234001 | G/C | 286 | Val/Leu (96) | 24 : 22 (0.52 : 0.48) | G/G (6) ; G/C (12) ; C/C (6) |
| | | | | | | rs2234002 | G/A | 512 | Ser/Asn (171) | 33 : 13 (0.72 : 0.28) | G/G (11) ; G/A (11) ; A/A (1) |
| | | | | | | rs2234003 | G/A | 571 | Ile/Val (191) | * | |
| T2R5 | AF227132 | AC064979.1 | 900 | 299 | 43779 - 44678 (+) | rs2234813 | G/A | 58 | Gly/Ser (20) | * | |
| SEQ ID NO: 7/8 | | | | | | rs2277264 | G/T | 77 | Ser/Ile (26) | 28 : 12 (0.7 : 0.3) | G/G (9) ; G/T (10) ; T/T (1) |
| | | | | | | NEW | C/T | 235 | Arg/Cys (79) | 1 | |
| | | | | | | rs2234814 | C/T | 338 | Pro/Leu (113) | 2 (only R seq) | |
| | | | | | | NEW | G/A | 363 | Arg/Arg (121) | 42 : 4 (0.91 : 0.09) | G/G (19) ; G/A (4) ; A/A (0) |
| | | | | | | NEW | G/A | 500 | Cys/Tyr (167) | 42 : 4 (0.91 : 0.09) | G/G (19) ; G/A (4) ; A/A (0) |
| | | | | | | rs2234815 | G/A | 638 | Arg/Gln (213) | 42 : 4 (0.91 : 0.09) | G/G (19) ; G/A (4) ; A/A (0) |

Figure 1B

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R7 | AF227133 | AC006518.17 | 957 | 318 | 525-1481 (-) | rs2234016 | G/T | 881 | Arg/Leu (294) | 1 | |
| SEQ ID NO. 9/10 | | | | | | rs3759254 | A/T | 787 | Thr/Ser (263) | * | |
| | | | | | | NEW | C/T | 788 | Thr/Met (263) | 43 : 3 (0.93 : 0.07) | C/C (28) : C/T (3) : T/T (0) |
| | | | | | | rs3759252 | C/A | 828 | Ile/Ile (276) | * | |
| | | | | | | rs619381 | G/A | 912 | Met/Ile (304) | * | |
| T2R8 | AF227134 | AC006518.17 | 930 | 309 | 4962-5891 (-) | NEW | A/G | 496 | Arg/Gly (166) | 2 | |
| SEQ ID NO. 11/12 | | | | | | rs1548893 | G/A | 549 | Leu/Leu (183) | 40 : 6 (0.87 : 0.13) | G/G (19) : G/A (2) : A/A (3) |
| | | | | | | NEW | T/C | 829 | Tyr/His (277) | 1 | |
| | | | | | | rs2537817 | G/A | 922 | Met/Val (308) | 24 : 2 (0.55 : 0.45) | G/G (6) : G/A (12) : A/A (4) |
| T2R9 | AF227135 | AC006518.17 | 939 | 312 | 8048-8986 (-) | NEW | C/A | 201 | Phe/Leu (67) | 43 : 3 (0.93 : 0.07) | C/C (20) : C/A (3) : A/A (1) |
| SEQ ID NO. 13/14 | | | | | | NEW | T/A | 450 | Asp/Glu (150) | 41 : 3 (0.93 : 0.07) | T/T (19) : T/A (3) : A/A (0) |
| | | | | | | rs3741845 | T/C | 560 | Val/Ala (187) | 34 : 10 (0.77 : 0.23) | T/T (15) : T/C (4) : C/C (3) |
| | | | | | | NEW | G/T | 867 | Leu/Phe (289) | 1 | |
| | | | | | | NEW | C/A | 880 | Leu/Met (294) | 1 | |
| | | | | | | rs3944635 | C/T | 910 | Leu/Phe (304) | * | |
| | | | | | | rs2159803 | C/T | 926 | Pro/Leu (309) | * | |
| T2R10 | AF227136 | AC006518.17 | 924 | 307 | 24357-25380 (-) | NEW | A/G | 126 | Leu/Leu (40) | 1 | |
| SEQ ID NO. 15/16 | | | | | | rs597468 | C/T | 467 | Thr/Met (156) | 16 : 36 (0.22 : 0.78) | C/C (0) : C/T (16) : T/T (13) |
| | | | | | | NEW | A/C | 521 | Lys/Thr (174) | 1 | |
| | | | | | | NEW | A/G | 564 | Leu/Leu (188) | 2 | |
| | | | | | | NEW | G/A | 627 | Ser/Ser (209) | 35 : 11 (0.76 : 0.24) | G/G (17) : G/A (11) : A/A (0) |

Figure 1C

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R13 | AF227137 | AC068518.17 | 912 | 303 | 107298 - 108209 (-) | rs1015443 | A/G | 776 | Asn/Ser (259) | 40 : 6 (0.87 : 0.13) | A/A (19) ; A/G (2) ; G/G (2) |
| SEQ ID NO: 17/18 | | | | | | | | | | | |
| T2R14 | AF227138 | AC068518.17 | 954 | 317 | 137165 - 138118 (-) | | | | | | |
| SEQ ID NO: 19/20 | | | | | | NEW | A/G | 256 | Thr/Ala (86) | | G/G (9) ; G/A (8) ; A/A (2) |
| | | | | | | rs3741843 | G/A | 375 | Arg/Arg (125) | 26 : 12 (0.68 : 0.32) | |
| T2R16 | AF227139 | AC004838.2 | 876 | 292 | 10968 - 11843 (+) | rs2233988 | C/T | 306 | Thr/Thr (100) | 26 : 12 (0.68 : 0.32) | C/C (9) ; C/T (8) ; T/T (3) |
| SEQ ID NO: 21/22 | | | | | | NEW | G/A | 301 | Val/Met (101) | | |
| | | | | | | rs2692396 | G/C | 303 | Val/Val (101) | 26 : 12 (0.68 : 0.32) | G/C (9) ; G/C (8) ; C/C (2) |
| | | | | | | rs2233989 | T/C | 460 | Leu/Leu (154) | 34 : 4 (0.89 : 0.11) | T/T (15) ; T/C (4)N - 4 (0) |
| | | | | | | rs846664 | T/G | 516 | Asn/Lys (172) | 26 : 12 (0.68 : 0.32) | T/T (9) ; T/G (8) ; G/G (2) |
| | | | | | | rs860170 | G/A | 665 | Arg/His (222) | 7 : 39 (0.15 : 0.85) | G/G (0) ; G/A (7) ; A/A (16) |
| | | | | | | rs1204014 | G/A | 845 | Thr/Thr (282) | 26 : 12 (0.68 : 0.32) | G/G (11) ; G/A (9) ; A/A (3) |
| T2R38 | AF494233 | AC073647.9 | 1002 | 333 | 55139 - 56130 (+) | rs713598 | C/G | 145 | Pro/Ala (49) | | |
| | | | | | | NEW | G/A | 239 | Arg/His (80) | | |
| | | | | | | rs1726866 | C/T | 785 | Ala/Val (262) | 1 or 2 | |
| | | | | | | NEW | C/T | 820 | Arg/Cys (274) | | |
| | | | | | | NEW | G/A | 886 | Val/Ile (296) | | |
| T2R39 (PTC07) | AF494230 | AC073342.3 | 934 (1047) | 337 (333) | 112 - 1117(+) | NEW | C/T | 578 | Ser/Phe (193) | 41 : 3 (0.93 : 0.07) | C/C (19) ; T/C (3) ; T/T (0) |
| SEQ ID NO: 25/26 | | | | | | NEW | G/A | 589 | Lys/Glu (197) | 41 : 3 (0.93 : 0.07) | A/A (19) ; A/G (3) ; G/G (0) |
| | | | | | | rs1603817 | G/A | 774 | Met/Ile (258) | | |
| T2R40 | AF494229 | AC073342.3 | 972 | 323 | 38763 - 39732 (+) | NEW | G/A | 560 | Ser/Tyr (187) | 38 : 8 (0.83 : 0.17) | C/C (17) ; C/A (4) ; A/A (2) |
| SEQ ID NO: 27/28 | | | | | | NEW | G/A | 817 | Thr/Ala (273) | 39 : 3 (0.93 : 0.07) | G/G (0) ; G/A (3) ; A/A (18) |

Figure 1D

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R41 (PTC01) SEQ ID NO: 29/30 | AF494232 | AC073264.5 | 924 | 307 | 27192 - 28115 (+) | rs1404635 | G/A | 189 | Thr/Thr (63) | -- | |
| | | | | | | NEW | C/T | 380 | Pro/Leu (127) | -- | |
| | | | | | | NEW | T/A | 584 | Val/Asp (195) | -- | |
| T2R43 SEQ ID NO: 31/32 | AF494237 | AC018650.40 | 930 | 309 | 48459 - 49388 (+) | NEW | G/C | 104 | Trp/Ser (35) | 30 : 4 (0.88 : 0.12) | G/G (15) : G/C (0) : C/C (2) |
| | | | | | | NEW | G/A | 279 | Val/Val (93) | 1 (RC1) | |
| | | | | | | NEW | G/C | 460 | Arg/Gly (145) | 1 (RC1) | |
| | | | | | | NEW | T/G | 510 | Ser/Arg (170) | 1 (RC1) | |
| | | | | | | NEW | G/T | 599 | Cys/Phe (200) | 1 (RC1) | |
| | | | | | | NEW | G/A | 635 | Arg/His (212) | 4 : 30 (0.12 : 0.88) | G/G (2) : G/A (0) : A/A (20) |
| | | | | | | NEW | C/G | 663 | Thr/Thr (221) | 31 : 3 (0.91 : 0.09) | C/C (15) : G/G (1) : G/G (1) |
| | | | | | | NEW | T/G | 882 | Phe/Leu (294) | 1 (RC1) | |
| | | | | | | NEW | T/C | 883 | Trp/Arg (295) | 1 (RC1) | |
| | | | | | | NEW | A/G | 889 | Met/Val (297) | 1 (RC1) | |
| T2R44 SEQ ID NO: 33/34 | AF494228 | AC018630.40 | 930 | 309 | 109353 - 110282 (+) | NEW | C/T | 103 | Arg/Trp (35) | 38 : 6 (0.84 : 0.14) | C/C (18) : C/T (2) : T/T (2) |
| | | | | | | NEW | T/C | 423 | Ala/Ala (141) | 5 : 39 (0.11 : 0.89) | T/T (18) : T/C (3) : C/C (1) |
| | | | | | | NEW | T/A | 484 | Met/Leu (162) | 34 : 10 (0.11 : 0.23) | T/T (15) : T/A (4) : A/A (2) |
| | | | | | | NEW | G/A | 599 | Cys/Tyr (200) | 2 | |
| | | | | | | NEW | C/G | 649 | Gln/Glu (217) | 1 | |
| | | | | | | NEW | C/T | 680 | Ala/Val (227) | 8 : 38 (0.17 : 0.83) | C/C (17) : C/T (4) : T/T (2) |
| | | | | | | NEW | G/A | 718 | Val/Ile (240) | 7 : 39 (0.43 : 0.67) | G/G (18) : G/A (3) : A/A (2) |
| | | | | | | NEW | A/G | 744 | Ser/Ser (248) | 3 : 43 (0.07 : 0.93) | A/A (0) : G/A (3) : G/G (29) |
| | | | | | | NEW | C/G | 827 | Pro/Arg (276) | 1 | |
| | | | | | | NEW | G/A | 843 | Trp/* (281) | 1 (RC1) | |
| T2R45 | AF494266 | | 900 | 299 | ? | | | | | | |

Figure 1E

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R46 | AF494227 | AC018630.40 | 900 (930) | 299 (309) | 78394 - 79323 (+) | NEW | T/G | 106 | Phe/Val (36) | 43:3 (0.93:0.07) | T/T (20); T/G (3); G/G (0) |
| SEQ ID NO: 35/36 | | | | | | NEW | T/A | 682 | Leu/Met (228) | 39:7 (0.85:0.15) | T/T (18); T/A (3); A/A (2) |
| | | | | | | NEW | G/A | 749 | Trp* (250) | 40:6 (0.87:0.13) | G/G (18); G/A (4); A/A (1) |
| | | | | | | NEW | C/T | 862 | Glu* (288) | 1 (BC1) | |
| T2R47 | AF494233 | AC018630.40 | 980 | 319 | 6444 - 7403 (+) | rs2597925 | G/A | 934 | Gly/Gly (314) | ? | |
| SEQ ID NO: 37/38 | | | | | | rs2597924 | G/A | 920 | Arg/His (307) | ? | |
| | | | | | | rs1669405 | T/G | 842 | Leu/Trp (281) | ? | |
| | | | | | | rs2599494 | T/G | 756 | Phe/Leu (252) | ? | |
| T2R48 | AF494234 | AC018630.40 | 900 | 299 | 118117 - 119016 (+) | NEW | C/T | 84 | Ala/Ala (28) | 38:8 (0.83:0.17) | C/C (17); C/T (4); T/T (2) |
| SEQ ID NO: 39/40 | | | | | | NEW | G/A | 94 | Val/Ile (32) | 33:13 (0.72:0.28) | G/G (12); G/A (9); A/A (2) |
| | | | | | | NEW | A/C | 326 | Lys/Thr (109) | 12:34 (0.26:0.74) | T/T (4); T/C (4); C/C (15) |
| | | | | | | rs1868769 | T/C | 418 | Leu/Leu (140) | - | - |
| | | | | | | NEW | A/T | 456 | Arg/Ser (152) | - | - |
| | | | | | | NEW | A/G | 673 | Ile/Val (225) | - | - |
| | | | | | | NEW | T/C | 715 | Ile/Thr (240) | - | - |
| | | | | | | NEW | G/C | 799 | Val/Leu (267) | 1 (PTC2) | |
| | | | | | | NEW | G/A | 883 | Trp* (295) | - | |
| | | | | | | NEW | C/T | 895 | Arg/Cys (299) | 38:8 (0.83:0.17) | C/C (17); C/T (4); T/T (2) |
| T2R49 | AF494236 | AC018630.40 | 930 | 309 | 142813 - 143742 (+) | NEW | A/G | 156 | Ala/Ala (52) | 6:32 (0.16:0.84) | A/A (15); A/G (2); G/G (2) |
| SEQ ID NO: 41/42 | | | | | | NEW | C/T | 261 | Ala/Ala (87) | 32:6 (0.84:0.16) | C/C (15); C/T (2); T/T (2) |
| | | | | | | NEW | G/A | 421 | Val/Ile (141) | 35:3 (0.92:0.08) | G/G (16); G/A (3); A/A (0) |
| | | | | | | NEW | C/A | 429 | His/Gln (143) | 32:6 (0.84:0.16) | C/C (15); C/A (2); A/A (2) |
| | | | | | | NEW | C/A | 442 | His/Asn (148) | 29:9 (0.76:0.24) | C/C (15); C/A (5); A/A (2) |
| | | | | | | NEW | G/A | 516 | Met/Ile (172) | - | |
| | | | | | | NEW | A/G | 706 | Ile/Val (236) | 6:32 (0.16:0.84) | A/A (15); A/G (2); G/G (2) |

Figure 1F

| GENE | RNA | BAC CLONE | SIZE (BP) | (AA) | POSITION | SNP | GENOME | RNA | PROTEIN | ALLELE FREQUENCY | GENOTYPE FREQUENCY |
|---|---|---|---|---|---|---|---|---|---|---|---|
| T2R50 SEQ ID NO: 43/44 | AF494235 | AC018639.40 | 908 | 299 | 153628 - 154727 (+) | NEW | T/C | 755 | Phe/Ser (252) | 32 : 6 (0.84 : 0.16) | T/T (15) : T/C (2) : C/C (2) |
|  |  |  |  |  |  | NEW | G/T | 764 | Arg/Leu (255) | 32 : 6 (0.84 : 0.16) | G/G (15) : G/T (3) : T/T (2) |
|  |  |  |  |  |  | NEW | A/G | 808 | Ile/Val (270) | ? | 2 |
|  |  |  |  |  |  | rs1376251 | G/A | 668 | Tyr/Cys (203) | ? |  |
| T2R60 SEQ ID NO: 45/46 | AY114094 | AC092214.3 NM_177437 | 957 | 318 | 62817 - 63773 (+) | NEW | A/T | 595 | Met/Leu (199) | 3 : 31 (0.09 : 0.91) | A/A (13) : A/T (3) : T/T (0) |
|  |  |  |  |  |  | NEW | C/T | 930 | Arg/Arg (310) | 24 : 22 (0.52 : 0.48) | C/C (7) : C/T (8) : T/T (8) |

VARIANTS OF HUMAN TASTE RECEPTOR GENES

CROSS REFERENCE TO RELATED APPLICATIONS

This is a continuation of U.S. application Ser. No. 10/561,487 (now U.S. Pat. No. 7,579,453), filed Dec. 19, 2005, which is a §371 U.S. National Stage of PCT/US2004/019489, filed Jun. 18, 2004, which was published in English under PCT Article 2(2), and which claims the benefit of U.S. Provisional Patent Application No. 60/480,035, filed Jun. 19, 2003. All of the above-listed applications are herein incorporated by reference in their entirety.

FIELD

This disclosure relates to the field of taste reception, and more particularly to variations in taste receptors, such as bitter taste receptors including those in the T2R family. It further relates to methods for identifying individuals and populations having certain taste receptor variants, and identifying compounds that interact with taste receptors, including compounds that interact differentially with different variants of a taste receptor.

BACKGROUND

Bitter taste is believed to have evolved in order to allow organisms to detect and avoid toxins from the environment. The sense of bitter taste is mediated by a group of 24 apparently functional bitter taste receptor proteins that reside on the surface of taste cells within the taste buds of the tongue. These receptors are 7-transmembrane domain, G protein coupled receptors, encoded by members of the T2R gene family. In contrast to T1Rs, which also belong to the superfamily of G protein-coupled receptors and have a large N-terminal domain, T2R bitter taste receptors generally have a short extracellular N terminus. These cell surface receptors interact with tastants and initiate signaling cascades that culminate in neurotransmitter release and bitter taste perception. The human genome contains 24 apparently functional T2R genes, which reside in three locations. Fourteen genes reside in a cluster on chromosome 12p13, nine genes reside in a cluster on chromosome 7q31, and a single family member resides on chromosome 5p15 (Shi, et al., *Mol. Biol. Evol.* 20:805-814, 2003). These genes all contain a single coding exon (approximately 1 kb in length) that encodes a receptor averaging approximately 300 amino acids in length.

Individual members of the T2R family exhibit 30%-70% amino acid identity. The most highly conserved sequence motifs reside in the first and last transmembrane segments, and also in the second cytoplasmic loop. The most divergent regions are the extracellular segments, extending partway into the transmembrane helices, possibly reflecting the need to recognize structurally diverse ligands.

Taste sensitivity to the bitter compound phenylthiocarbamide (PTC) and related chemicals is bimodally distributed, and virtually all human populations tested to date contain some people who can (tasters) and some people who cannot taste (nontasters) PTC. The frequency of tasters in North Americans of European ancestry is about 70%. The PTC taste receptor encoded on chromosome 7 was recently identified as a taste receptor that mediates the bitter taste of at least PTC (Kim et al., Science 299:1221-1225, 2003).

Although PTC itself has not been found in nature, the ability to taste PTC is correlated strongly with the ability to taste other naturally occurring bitter substances, many of which are toxic (Harris and Kalmus, *Ann Eugen* 15:32-45, 1949; Barnicot et al., *Ann Eugen* 16:119-128, 19; Tepper, *Am J Hum Genet* 63:1271-1276, 1998). Furthermore, variation in PTC taste sensitivity has been correlated with dietary preferences that may have significant health effects (Bartoshuk et al. 1994). For example, PTC is similar in structure to isothiocyanates (compounds containing the group N—C=S) and goitrin, both of which are bitter substances found in cruciferous vegetables like cabbage and broccoli (Tepper, *Am J Hum Genet* 63:1271-1276, 1998). Variable aversions to these compounds have been implicated in the variable rates of thyroid-deficiency disease in PTC tasters and nontasters, with nontasters being more susceptible (Drewnowski and Rock, *Am J Clin Nutr* 62:506-511, 1995).

Identifying receptor-ligand relationships for T2Rs has been difficult, and the nature of the ligand that binds to each receptor and initiates bitter taste perception is known for only a few of these receptors. In humans, in vitro cell based assays have shown that T2R16 responds to salicin and other beta-glucopyranosides and T2R10 displays activity upon exposure to strychnine (Bufe, et al., *Nat. Genet.* 32:397-401, 2002). An alternative human genetic approach has revealed that T2R38 (PTC) encodes the receptor for phenylthiocarbamide, a classic variant trait in humans (Kim, et al., *Science* 299:1221-1225, 2003). The bitter tastant ligands that activate the remaining 22 human T2R proteins are not well characterized.

SUMMARY OF THE DISCLOSURE

This disclosure provides a comprehensive collection of single nucleotide polymorphisms (SNPs) in bitter taste receptor (T2R) genes (FIG. 1). It is believed that a portion of these SNPs define biologically relevant difference between different alleles of the bitter taste receptor genes. Included in the disclosure are sub-sets of the bitter taste receptor SNPs that represent conserved, non-conserved, silent, and truncation mutations in the corresponding proteins, as well as individual allelic sequences for the various bitter taste receptor genes.

The disclosure further provides methods for using the corresponding allelic variants of the taste receptor genes, alone or in various combinations, to test a subject's bitter tasting profile, and to identify and analyze compounds that interact with and/or influence bitter tastes in subjects.

Also provided is a substantially comprehensive set of haplotypes for nearly all of the T2R bitter taste receptors (T2R1, T2R3, T2R4, T2R5, T2R7, T2R8, T2R9, T2R10, T2R13, T2R14, T2R16, T2R38, T2R39, T2R40, T2R41, T2R42, T2R43, T2R44, T2R45, T2R46, T2R47, T2R48, T2R49, T2R50, and T2R60). Details of the haplotypes, and the T2R isoforms encoded thereby, are provided in Table 7.

The foregoing and other features and advantages will become more apparent from the following detailed description of several embodiments, which proceeds with reference to the accompanying figures.

BRIEF DESCRIPTION OF THE FIGURES

FIG. 1 (including pages 1-5) is a table showing SNPs identified in the indicated T2R bitter taste receptor genes.

SEQUENCE LISTING

Figure 2:
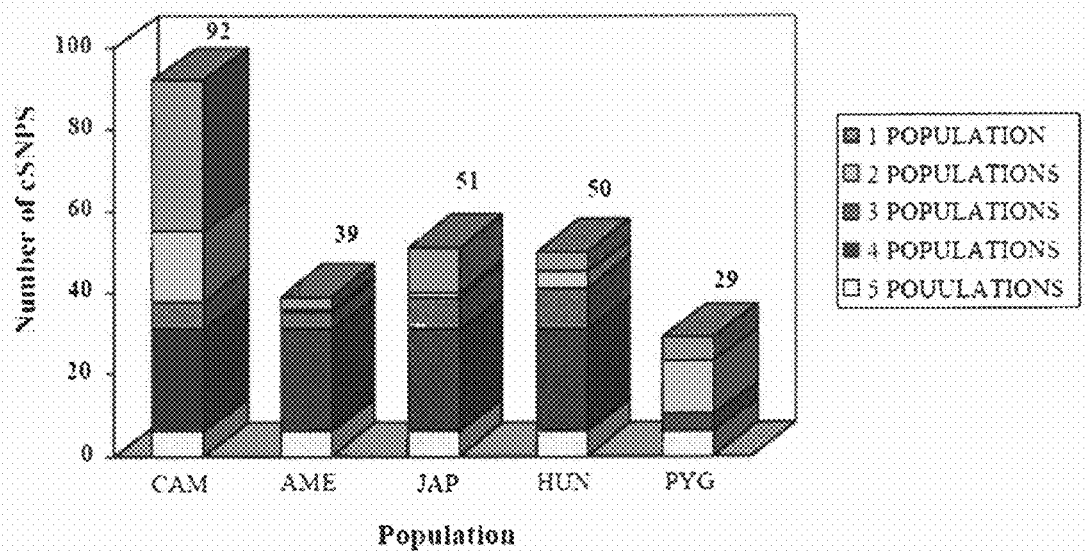
FIG. 2 is a graph showing the distribution of cSNPs among the five population samples. The cSNPs were categorized as to whether they were variable in one, two, three, four, or all five populations. Population codes are CAM, Cameroonians; AME, Amerindians; JAP, Japanese; HUG, Hungarians; PYG; Pygmies.

The DNA and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. In the accompanying sequence listing:

SEQ ID NO: 1 shows the coding nucleic acid sequence of bitter taste receptor gene T2R1, and the protein encoded thereby. Two SNPs are indicated.

SEQ ID NO: 2 shows the protein sequence of the T2R1 bitter taste receptor.

SEQ ID NO: 3 shows the coding nucleic acid sequence of bitter taste receptor gene T2R3, and the protein encoded thereby. Three SNPs are indicated.

SEQ ID NO: 4 shows the protein sequence of the T2R3 bitter taste receptor.

SEQ ID NO: 5 shows the coding nucleic acid sequence of bitter taste receptor gene T2R4, and the protein encoded thereby. Six SNPs are indicated.

SEQ ID NO: 6 shows the protein sequence of the T2R4 bitter taste receptor.

SEQ ID NO: 7 shows the coding nucleic acid sequence of bitter taste receptor gene T2R5, and the protein encoded thereby. Six SNPs are indicated.

SEQ ID NO: 8 shows the protein sequence of the T2R5 bitter taste receptor.

SEQ ID NO: 9 shows the coding nucleic acid sequence of bitter taste receptor gene T2R7, and the protein encoded thereby. One SNP is indicated.

SEQ ID NO: 10 shows the protein sequence of the T2R7 bitter taste receptor.

SEQ ID NO: 11 shows the coding nucleic acid sequence of bitter taste receptor gene T2R8, and the protein encoded thereby. Four SNPs are indicated.

SEQ ID NO: 12 shows the protein sequence of the T2R8 bitter taste receptor.

SEQ ID NO: 13 shows the coding nucleic acid sequence of bitter taste receptor gene T2R9, and the protein encoded thereby. Five SNPs are indicated.

SEQ ID NO: 14 shows the protein sequence of the T2R9 bitter taste receptor.

SEQ ID NO: 15 shows the coding nucleic acid sequence of bitter taste receptor gene T2R10, and the protein encoded thereby. Five SNPs are indicated.

SEQ ID NO: 16 shows the protein sequence of the T2R10 bitter taste receptor.

SEQ ID NO: 17 shows the coding nucleic acid sequence of bitter taste receptor gene T2R13, and the protein encoded thereby. One SNP is indicated.

SEQ ID NO: 18 shows the protein sequence of the T2R13 bitter taste receptor.

SEQ ID NO: 19 shows the coding nucleic acid sequence of bitter taste receptor gene T2R14, and the protein encoded thereby. Two SNPs are indicated.

SEQ ID NO: 20 shows the protein sequence of the T2R14 bitter taste receptor.

SEQ ID NO: 21 shows the coding nucleic acid sequence of bitter taste receptor gene T2R16, and the protein encoded thereby. Seven SNPs are indicated.

SEQ ID NO: 22 shows the protein sequence of the T2R16 bitter taste receptor.

SEQ ID NO: 23 shows the coding nucleic acid sequence of bitter taste receptor gene T2R38, and the protein encoded thereby. Five SNPs are indicated.

SEQ ID NO: 24 shows the protein sequence of the T2R38 bitter taste receptor, also known as the PTC taste receptor.

SEQ ID NO: 25 shows the coding nucleic acid sequence of bitter taste receptor gene T2R39, and the protein encoded thereby. Two SNPs are indicated.

SEQ ID NO: 26 shows the protein sequence of the T2R39 bitter taste receptor.

SEQ ID NO: 27 shows the coding nucleic acid sequence of bitter taste receptor gene T2R40, and the protein encoded thereby. Two SNPs are indicated.

SEQ ID NO: 28 shows the protein sequence of the T2R40 bitter taste receptor.

SEQ ID NO: 29 shows the coding nucleic acid sequence of bitter taste receptor gene T2R41, and the protein encoded thereby. Three SNPs are indicated.

SEQ ID NO: 30 shows the protein sequence of the T2R41 bitter taste receptor.

SEQ ID NO: 31 shows the coding nucleic acid sequence of bitter taste receptor gene T2R43 (GenBank Accession No. AF494237), and the protein encoded thereby. Ten SNPs are indicated.

SEQ ID NO: 32 shows the protein sequence of the T2R43 bitter taste receptor.

SEQ ID NO: 33 shows the coding nucleic acid sequence of bitter taste receptor gene T2R44, and the protein encoded thereby. Ten SNPs are indicated.

SEQ ID NO: 34 shows the protein sequence of the T2R44 bitter taste receptor.

SEQ ID NO: 35 shows the coding nucleic acid sequence of bitter taste receptor gene T2R46, and the protein encoded thereby. Four SNPs are indicated.

SEQ ID NO: 36 shows the protein sequence of the T2R46 bitter taste receptor.

SEQ ID NO: 37 shows the coding nucleic acid sequence of bitter taste receptor gene T2R47, and the protein encoded thereby.

SEQ ID NO: 38 shows the protein sequence of the T2R47 bitter taste receptor.

SEQ ID NO: 39 shows the coding nucleic acid sequence of bitter taste receptor gene T2R48, and the protein encoded thereby. Ten SNPs are indicated.

SEQ ID NO: 40 shows the protein sequence of the T2R48 bitter taste receptor.

SEQ ID NO: 41 shows the coding nucleic acid sequence of bitter taste receptor gene T2R49, and the protein encoded thereby. Ten SNPs are indicated.

SEQ ID NO: 42 shows the protein sequence of the T2R49 bitter taste receptor.

SEQ ID NO: 43 shows the coding nucleic acid sequence of bitter taste receptor gene T2R50, and the protein encoded thereby.

SEQ ID NO: 44 shows the protein sequence of the T2R50 bitter taste receptor.

SEQ ID NO: 45 shows the coding nucleic acid sequence of bitter taste receptor gene T2R60, and the protein encoded thereby. Two SNPs are indicated.

SEQ ID NO: 46 shows the protein sequence of the T2R60 bitter taste receptor.

SEQ ID NOs: 47 (GenBank Accession No. AF227129), 49, and 51 (GenBank Accession No. AC026787.5) show the coding nucleic acid sequence of haplotypes of the T2R1 bitter taste receptor gene, and the proteins encoded thereby.

SEQ ID NOs: 48, 50, and 52 show the protein sequences of the haplotypes of the T2R1 bitter taste receptor.

SEQ ID NOs: 53 (GenBank Accession No. AF227130) and 55 show the coding nucleic acid sequence of haplotypes of the T2R3 bitter taste receptor gene, and the proteins encoded thereby.

SEQ ID NOs: 54 and 56 show the protein sequences of the haplotypes of the T2R3 bitter taste receptor.

SEQ ID NOs: 57, 59, 61 (GenBank Accession No. AF227131), 63, 65, 67, 69, and 71 show the coding nucleic acid sequence of haplotypes of the T2R4 bitter taste receptor gene, and the proteins encoded thereby.

SEQ ID NOs: 58, 60, 62, 64, 66, 68, 70, and 72 show the protein sequences of the haplotypes of the T2R4 bitter taste receptor.

SEQ ID NOs: 73 (GenBank Accession No. AF227132), 75, 77, 79, 81, 83, and 85 show the coding nucleic acid sequence of haplotypes of the T2R5 bitter taste receptor gene, and the proteins encoded thereby.

SEQ ID NOs: 74, 76, 78, 80, 82, 84, and 86 show the protein sequences of the haplotypes of the T2R5 bitter taste receptor.

SEQ ID NOs: 87 (GenBank Accession No. AF227133), 89, 91, 93, and 95 show the coding nucleic acid sequence of haplotypes of the T2R7 bitter taste receptor gene, and the proteins encoded thereby.

SEQ ID NOs: 88, 90, 92, 94, and 96 show the protein sequences of the haplotypes of the T2R7 bitter taste receptor.

SEQ ID NOs: 97 (GenBank Accession No. AF227134), 99, 101, 103, 105, and 107 show the coding nucleic acid sequence of haplotypes of the T2R8 bitter taste receptor gene, and the proteins encoded thereby.

SEQ ID NOs: 98, 100, 102, 104, 106, and 108 show the protein sequences of the haplotypes of the T2R8 bitter taste receptor.

SEQ ID NOs: 109 (GenBank Accession No. AF227135), 111, 113, 115, 117, 119, 121, and 123 show the coding nucleic acid sequence of haplotypes of the T2R9 bitter taste receptor gene, and the proteins encoded thereby.

SEQ ID NOs: 110, 112, 114, 116, 118, 120, 122, and 124 show the protein sequences of the haplotypes of the T2R9 bitter taste receptor.

SEQ ID NOs: 125, 127, 129, and 131 (GenBank Accession No. AF227136) show the coding nucleic acid sequence of haplotypes of the T2R10 bitter taste receptor gene, and the proteins encoded thereby.

SEQ ID NOs: 126, 128, 130, and 132 show the protein sequences of the haplotypes of the T2R10 bitter taste receptor.

SEQ ID NOs: 133 (GenBank Accession No. AF227137) and 135 show the coding nucleic acid sequence of haplotypes of the T2R13 bitter taste receptor gene, and the proteins encoded thereby.

SEQ ID NOs: 134 and 136 show the protein sequences of the haplotypes of the T2R13 bitter taste receptor.

SEQ ID NOs: 137 (GenBank Accession No. AF227138), 139, and 141 show the coding nucleic acid sequence of haplotypes of the T2R14 bitter taste receptor gene, and the proteins encoded thereby.

SEQ ID NOs: 138, 140, and 142 show the protein sequences of the haplotypes of the T2R14 bitter taste receptor.

SEQ ID NOs: 143 (GenBank Accession No. CQ740130.1), 145 (GenBank Accession No. AF227139), 147, 149, and 151 show the coding nucleic acid sequence of haplotypes of the T2R16 bitter taste receptor gene, and the proteins encoded thereby.

SEQ ID NOs: 144, 146, 148, 150, and 152 show the protein sequences of the haplotypes of the T2R16 bitter taste receptor.

SEQ ID NOs: 153 (GenBank Accession No. AY258597.1), 155, 157, 159 (GenBank Accession Nos. AX647247.1 and AY114095.1), 161, 163, and 165 (GenBank Accession No. AF494231) show the coding nucleic acid sequence of haplotypes of the T2R38 bitter taste receptor gene, and the proteins encoded thereby.

SEQ ID NOs: 154, 156, 158, 160, 162, 164, and 166 show the protein sequences of the haplotypes of the T2R38 bitter taste receptor.

SEQ ID NOs: 167 (GenBank Accession No. AF494230) and 169 show the coding nucleic acid sequence of haplotypes of the T2R39 bitter taste receptor gene, and the proteins encoded thereby.

SEQ ID NOs: 168 and 170 show the protein sequences of the haplotypes of the T2R39 bitter taste receptor.

SEQ ID NOs: 171 (GenBank Accession No. AF494229), 173, 175, and 179 show the coding nucleic acid sequence of haplotypes of the T2R40 bitter taste receptor gene, and the proteins encoded thereby.

SEQ ID NOs: 172, 174, 176, and-180 show the protein sequences of the haplotypes of the T2R40 bitter taste receptor.

SEQ ID NOs: 181, 183, and 185 (GenBank Accession No. AF494232) show the coding nucleic acid sequence of haplotypes of the T2R41 bitter taste receptor gene, and the proteins encoded thereby.

SEQ ID NOs: 182, 184, and 186 show the protein sequences of the haplotypes of the T2R41 bitter taste receptor.

SEQ ID NOs: 187, 189, 191, 193 (GenBank Accession No. AF494228), 195 (GenBank Accession No. AX647301.1 and AC018630.40), 197, and 199 show the coding nucleic acid sequence of haplotypes of the T2R44 bitter taste receptor gene, and the proteins encoded thereby.

SEQ ID NOs: 188, 190, 192, 194, 196, 198, and 200 show the protein sequences of the haplotypes of the T2R44 bitter taste receptor.

SEQ ID NOs: 201, 203, 205, 207 (GenBank Accession No. AF494227), 209, and 211 show the coding nucleic acid sequence of haplotypes of the T2R46 bitter taste receptor gene, and the proteins encoded thereby.

SEQ ID NOs: 202, 204, 206, 208, 210, and 212 show the protein sequences of the haplotypes of the T2R46 bitter taste receptor.

SEQ ID NOs: 213, 215 (GenBank Accession No. AF494233), 217, and 219 show the coding nucleic acid sequence of haplotypes of the T2R47 bitter taste receptor gene, and the proteins encoded thereby.

SEQ ID NOs: 214, 216, 218, and 220 show the protein sequences of the haplotypes of the T2R47 bitter taste receptor.

SEQ ID NOs: 221 (GenBank Accession no. CQ800016.1), 223 (GenBank Accession No. AF494234), 225, 227, 229, 231, 233, 235, and 237 show the coding nucleic acid sequence of haplotypes of the T2R48 bitter taste receptor gene, and the proteins encoded thereby.

SEQ ID NOs: 222, 224, 226, 228, 230, 232, 234, 236, and 238 show the protein sequences of the haplotypes of the T2R48 bitter taste receptor.

SEQ ID NOs: 239 (GenBank Accession No. AF494236), 241, 243, 245, 247, 249 and 251 show the coding nucleic acid sequence of haplotypes of the T2R49 bitter taste receptor gene, and the proteins encoded thereby.

SEQ ID NOs: 240, 242, 244, 246, 248, 250, and 252 show the protein sequences of the haplotypes of the T2R49 bitter taste receptor.

SEQ ID NOs: 253, 255 (GenBank Accession No. AF494235), 257, and 259 show the coding nucleic acid sequence of haplotypes of the T2R50 bitter taste receptor gene, and the proteins encoded thereby.

SEQ ID NOs: 254, 256, 258 and 260 show the protein sequences of the haplotypes of the T2R50 bitter taste receptor.

SEQ ID NOs: 261 (GenBank Accession No. AY114094) and 263 show the coding nucleic acid sequence of haplotypes of the T2R60 bitter taste receptor gene, and the proteins encoded thereby.

SEQ ID NOs: 262 and 264 show the protein sequences of the haplotypes of the T2R60 bitter taste receptor.

DETAILED DESCRIPTION

I. Abbreviations

| | |
|---|---|
| 2D-PAGE | two-dimensional polyacrylamide gel electrophoresis |
| ASO | allele-specific oligonucleotide |
| ASOH | allele-specific oligonucleotide hybridization |
| DASH | dynamic allele-specific hybridization |
| ELISA | enzyme-linked immunosorbant assay |
| HPLC | high pressure liquid chromatography |
| MALDI-TOF | matrix-assisted laser desorption/ionization time-of-flight |
| PCR | polymerase chain reaction |
| RT-PCR | reverse-transcription polymerase chain reaction |
| SNP | single nucleotide polymorphism |
| SSCP | single-strand conformation polymorphism |

II. Terms

Unless otherwise noted, technical terms are used according to conventional usage. Definitions of common terms in molecular biology may be found in Benjamin Lewin, *Genes V*, published by Oxford University Press, 1994 (ISBN 0-19-854287-9); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN 1-56081-569-8).

In order to facilitate review of the various embodiments of the invention, the following explanations of specific terms are provided:

Addressable: Capable of being reliably and consistently located and identified, as in an addressable location on an array.

Allele: A particular form of a genetic locus, distinguished from other forms by its specific nucleotide sequence.

Amplified RNA (amRNA): A molecule of RNA generated through in vitro transcription with T7 or other promoter region attached to the 5' end of the template.

Antisense, Sense, and Antigene: Double-stranded DNA (dsDNA) has two strands, a 5'→3' strand, referred to as the plus strand, and a 3'→5' strand (the reverse complement), referred to as the minus strand. Because RNA polymerase adds nucleic acids in a 5'→3' direction, the minus strand of the DNA serves as the template for the RNA during transcription. Thus, the RNA formed will have a sequence complementary to the minus strand and identical to the plus strand (except that U is substituted for T).

Antisense molecules are molecules that are specifically hybridizable or specifically complementary to either RNA or the plus strand of DNA. Sense molecules are molecules that are specifically hybridizable or specifically complementary to the minus strand of DNA. Antigene molecules are either antisense or sense molecules directed to a dsDNA target.

Array: An arrangement of molecules, particularly biological macromolecules (such as polypeptides or nucleic acids) or biological samples (such as tissue sections) in addressable locations on a substrate, usually a flat substrate such as a membrane, plate or slide. The array may be regular (arranged in uniform rows and columns, for instance) or irregular. The number of addressable locations on the array can vary, for example from a few (such as three) to more than 50, 100, 200, 500, 1000, 10,000, or more. A "microarray" is an array that is miniaturized to such an extent that it benefits from microscopic examination for evaluation.

Within an array, each arrayed molecule (e.g., oligonucleotide) or sample (more generally, a "feature" of the array) is addressable, in that its location can be reliably and consistently determined within the at least two dimensions on the array surface. Thus, in ordered arrays the location of each feature is usually assigned to a sample at the time when it is spotted onto or otherwise applied to the array surface, and a key may be provided in order to correlate each location with the appropriate feature.

Often, ordered arrays are arranged in a symmetrical grid pattern, but samples could be arranged in other patterns (e.g., in radially distributed lines, spiral lines, or ordered clusters). Arrays are computer readable, in that a computer can be programmed to correlate a particular address on the array with information (such as identification of the arrayed sample and hybridization or binding data, including for instance signal intensity). In some examples of computer readable array formats, the individual spots on the array surface will be arranged regularly, for instance in a Cartesian grid pattern, that can be correlated to address information by a computer.

The sample application spot (or feature) on an array may assume many different shapes. Thus, though the term "spot" is used herein, it refers generally to a localized deposit of nucleic acid or other biomolecule, and is not limited to a round or substantially round region. For instance, substantially square regions of application can be used with arrays, as can be regions that are substantially rectangular (such as a slot blot-type application), or triangular, oval, irregular, and so forth. The shape of the array substrate itself is also immaterial, though it is usually substantially flat and may be rectangular or square in general shape.

Binding or interaction: An association between two substances or molecules, such as the hybridization of one nucleic acid molecule to another (or itself). Disclosed arrays are used to detect binding of, in some embodiments, a labeled nucleic acid molecule (target) to an immobilized nucleic acid molecule (probe) in one or more features of the array. A labeled target molecule "binds" to a nucleic acid molecule in a spot on an array if, after incubation of the (labeled) target molecule (usually in solution or suspension) with or on the array for a period of time (usually 5 minutes or more, for instance 10 minutes, 20 minutes, 30 minutes, 60 minutes, 90 minutes, 120 minutes or more, for instance over night or even 24 hours), a detectable amount of that molecule associates with a nucleic acid feature of the array to such an extent that it is not removed by being washed with a relatively low stringency buffer (e.g., higher salt (such as 3×SSC or higher), room temperature washes). Washing can be carried out, for instance, at room temperature, but other temperatures (either higher or lower) also can be used. Targets will bind probe nucleic acid molecules within different features on the array to different extents, based at least on sequence homology, and the term "bind" encompasses both relatively weak and relatively strong interactions. Thus, some binding will persist after the array is washed in a more stringent buffer (e.g., lower salt (such as about 0.5 to about 1.5×SSC), 55-65° C. washes).

Where the probe and target molecules are both nucleic acids, binding of the test or reference molecule to a feature on the array can be discussed in terms of the specific complementarity between the probe and the target nucleic acids. Also contemplated herein are protein-based arrays, where the probe molecules are or comprise proteins, and/or where the target molecules are or comprise proteins.

cDNA: A DNA molecule lacking internal, non-coding segments (e.g., introns) and regulatory sequences that determine transcription. By way of example, cDNA may be synthesized in the laboratory by reverse transcription from messenger RNA extracted from cells.

DNA (deoxyribonucleic acid): DNA is a long chain polymer that contains the genetic material of most living organisms (the genes of some viruses are made of ribonucleic acid (RNA)). The repeating units in DNA polymers are four different nucleotides, each of which includes one of the four bases (adenine, guanine, cytosine and thymine) bound to a deoxyribose sugar to which a phosphate group is attached. Triplets of nucleotides (referred to as codons) code for each amino acid in a polypeptide, or for a stop signal. The term "codon" is also used for the corresponding (and complementary) sequences of three nucleotides in the mRNA into which the DNA sequence is transcribed.

Enriched: The term "enriched" means that the concentration of a material is at least about 2, 5, 10, 100, or 1000 times its natural concentration (for example), advantageously at least 0.01% by weight. Enriched preparations of about 0.5%, 1%, 5%, 10%, and 20% by weight are also contemplated.

EST (Expressed Sequence Tag): A partial DNA or cDNA sequence, typically of between 200 and 2000 sequential nucleotides, obtained from a genomic or cDNA library, prepared from a selected cell, cell type, tissue or tissue type, organ or organism, which corresponds to an mRNA of a gene found in that library. An EST is generally a DNA molecule sequenced from and shorter than the cDNA from which it is obtained.

Fluorophore: A chemical compound, which when excited by exposure to a particular wavelength of light, emits light (i.e., fluoresces), for example at a different wavelength. Fluorophores can be described in terms of their emission profile, or "color." Green fluorophores, for example Cy3, FITC, and Oregon Green, are characterized by their emission at wavelengths generally in the range of 515-540λ. Red fluorophores, for example Texas Red, Cy5 and tetramethylrhodamine, are characterized by their emission at wavelengths generally in the range of 590-690 λ.

Examples of fluorophores are provided in U.S. Pat. No. 5,866,366 to Nazarenko et al., and include for instance: 4-acetamido-4'-isothiocyanatostilbene-2,2'disulfonic acid, acridine and derivatives such as acridine and acridine isothiocyanate, 5-(2'-aminoethyl)aminonaphthalene-1-sulfonic acid (EDANS), 4-amino-N-[3-vinylsulfonyl)phenyl]naphthalimide-3,5 disulfonate (Lucifer Yellow VS), N-(4-anilino-1-naphthyl)maleimide, anthranilamide, Brilliant Yellow, coumarin and derivatives such as coumarin, 7-amino-4-methylcoumarin (AMC, Coumarin 120), 7-amino-4-trifluoromethylcouluarin (Coumaran 151); cyanosine; 4',6-diaminidino-2-phenylindole (DAPI); 5',5"-dibromopyrogallol-sulfonephthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino] naphthalene-1-sulfonyl chloride (DNS, dansyl chloride); 4-(4'-dimethylaminophenylazo)benzoic acid (DABCYL); 4-dimethylaminophenylazophenyl-4'-isothiocyanate (DABITC); eosin and derivatives such as eosin and eosin isothiocyanate; erythrosin and derivatives such as erythrosin B and erythrosin isothiocyanate; ethidium; fluorescein and derivatives such as 5-carboxyfluorescein (FAM), 5-(4,6-dichlorotriazin-2-yl)aminofluorescein (DTAF), 2'7'-dimethoxy-4'5'-dichloro-6-carboxyfluorescein (JOE), fluorescein, fluorescein isothiocyanate (FITC), and QFITC (XRITC); fluorescamine; IR144; IR1446; Malachite Green isothiocyanate; 4-methylumbelliferone; ortho cresolphthalein; nitrotyrosine; pararosaniline; Phenol Red; B-phycoerythrin; o-phthaldialdehyde; pyrene and derivatives such as pyrene, pyrene butyrate and succinimidyl 1-pyrene butyrate; Reactive Red 4 (Cibacron® Brilliant Red 3B-A); rhodamine and derivatives such as 6-carboxy-X-rhodamine (ROX), 6-carboxyrhodamine (R6G), lissamine rhodamine B sulfonyl chloride, rhodamine (Rhod), rhodamine B, rhodamine 123, rhodamine X isothiocyanate, sulforhodamine B, sulforhodamine 101 and sulfonyl chloride derivative of sulforhodamine 101 (Texas Red); N,N,N',N'-tetramethyl-6-carboxyrhodamine (TAMRA); tetramethyl rhodamine; tetramethyl rhodamine isothiocyanate (TRITC); riboflavin; rosolic acid and terbium chelate derivatives.

Other contemplated fluorophores include GFP (green fluorescent protein), Lissamine™, diethylaminocoumarin, fluorescein chlorotriazinyl, naphthofluorescein, 4,7-dichlororhodamine and xanthene and derivatives thereof. Other fluorophores known to those skilled in the art may also be used.

Examples of fluorophores that are sensitive to ion concentration (such as $Ca^{2+}$ concentration or flux) include, but are not limited to, bis-(1,3-dibutylbarbituric acid)trimethine oxonol (DiBAC4(3) (B-438), Quin-2 (AM Q-1288), Fura-2 (AM F-1225), Indo-1 (AM I-1226), Fura-3 (AM F-1228), Fluo-3 (AM F-1241), Rhod-2, (AM R-1244), BAPTA (AM B-1205), 5,5'-dimethyl BAPTA (AM D-1207), 4,4'-difluoro BAPTA (AM D-1216), 5,5'-difluoro BAPTA (AM D-1209), 5,5'-dibromo BAPTA (AM D-1213), Calcium Green (C-3011), Calcium Orange (C-3014), Calcium Crimson (C-3017), Fura-5 (F-3023), Fura-Red (F-3020), SBFI (S-1262), PBFI (P-1265), Mag-Fura-2 (AM M-1291), Mag-Indo-1 (AM M-1294), Mag-Quin-2 (AM M-1299), Mag-Quin-1 (AM M-1297), SPQ (M-440), SPA (S-460), Calcien (Fluorescein-bis(methyliminodiacetic acid); Fluorexon), and Quin-2 (2-{[2-Bis-(carboxymethyl)amino-5-methylphenoxyl]-methyl}-6-methoxy-8-bis-(carboxymethyl)aminoquinoline tetrapotassium salt). Many of these (and other calcium sensing compounds known to those of ordinary skill) are available, for instance, from Molecular Probes, Invitrogen Detection Technologies, Eugene, Oreg.

Haplotype: The ordered, linear combination of polymorphisms (e.g., SNPs) in the sequence of each form of a gene (on individual chromosomes) that exists in the population.

Haplotyping: Any process for determining one or more haplotypes in an individual. Example methods are described herein, and may include use of family pedigrees, molecular biological techniques, statistical inference, or any combination thereof.

High throughput genomics: Application of genomic or genetic data or analysis techniques that use microarrays or other genomic technologies to rapidly identify large numbers of genes or proteins, or distinguish their structure, expression or function from normal or abnormal cells or tissues, or from cells or tissues of subjects with known or unknown phenotype and/or genotype.

Human Cells: Cells obtained from a member of the species Homo sapiens. The cells can be obtained from any source, for example peripheral blood, urine, saliva, tissue biopsy, surgical specimen, amniocentesis samples and autopsy material. From these cells, genomic DNA, mRNA, cDNA, RNA, and/or protein can be isolated.

Hybridization: Nucleic acid molecules that are complementary to each other hybridize by hydrogen bonding, which includes Watson-Crick, Hoogsteen or reversed Hoogsteen hydrogen bonding between complementary nucleotide units. For example, adenine and thymine are complementary nucleobases that pair through formation of hydrogen bonds. "Complementary" refers to sequence complementarity between two nucleotide units. For example, if a nucleotide unit at a certain position of an oligonucleotide is capable of hydrogen bonding with a nucleotide unit at the same position of a DNA or RNA molecule, then the oligonucleotides are complementary to each other at that position. The oligonucleotide and the DNA or RNA are complementary to each other when a sufficient number of corresponding positions in each molecule are occupied by nucleotide units which can hydrogen bond with each other.

"Specifically hybridizable" and "complementary" are terms that indicate a sufficient degree of complementarity such that stable and specific binding occurs between the oligonucleotide and the DNA or RNA or PNA target. An oligonucleotide need not be 100% complementary to its target nucleic acid sequence to be specifically hybridizable. An oligonucleotide is specifically hybridizable when binding of the oligonucleotide to the target DNA or RNA molecule interferes with the normal function of the target DNA or RNA, and there is a sufficient degree of complementarity to avoid non-specific binding of the oligonucleotide to non-target sequences under conditions in which specific binding is desired, for example under physiological conditions in the case of in vivo assays, or under conditions in which the assays are performed.

Hybridization conditions resulting in particular degrees of stringency will vary depending upon the nature of the hybridization method of choice and the composition and length of the hybridizing DNA used. Generally, the temperature of hybridization and the ionic strength (especially the $Na^+$ concentration) of the hybridization buffer will determine the stringency of hybridization. Calculations regarding hybridization conditions required for attaining particular degrees of stringency are discussed by Sambrook et al. in *Molecular Cloning: A Laboratory Manual*, Cold Spring Harbor Laboratory Press (1989), chapters 9 and 11, herein incorporated by reference.

In vitro amplification: Techniques that increase the number of copies of a nucleic acid molecule in a sample or specimen. An example of in vitro amplification is the polymerase chain reaction, in which a biological sample collected from a subject is contacted with a pair of oligonucleotide primers, under conditions that allow for the hybridization of the primers to nucleic acid template in the sample. The primers are extended under suitable conditions, dissociated from the template, and then re-annealed, extended, and dissociated to amplify the number of copies of the nucleic acid.

The product of in vitro amplification may be characterized by electrophoresis, restriction endonuclease cleavage patterns, oligonucleotide hybridization or ligation, and/or nucleic acid sequencing, using standard techniques.

Other examples of in vitro amplification techniques include strand displacement amplification (see U.S. Pat. No. 5,744,311); transcription-free isothermal amplification (see U.S. Pat. No. 6,033,881); repair chain reaction amplification (see WO 90/01069); ligase chain reaction amplification (see EP-A-320 308); gap filling ligase chain reaction amplification (see U.S. Pat. No. 5,427,930); coupled ligase detection and PCR (see U.S. Pat. No. 6,027,889); and NASBA™ RNA transcription-free amplification (see U.S. Pat. No. 6,025,134).

Isoform: As used herein, the term isoform refers to a protein with a unique amino acid sequence specified by one haplotype of a gene, such as a T2R bitter receptor gene. By way of example, specific examples of T2R isoforms are shown in the sequence listing, SEQ ID NOs: 48-264 (even).

Isolated: An "isolated" biological component (such as a nucleic acid molecule, protein or organelle) has been substantially separated or purified away from other biological components in the cell of the organism in which the component naturally occurs, i.e., other chromosomal and extra-chromosomal DNA and RNA, proteins and organelles. Nucleic acids and proteins that have been "isolated" include nucleic acids and proteins purified by standard purification methods. The term also embraces nucleic acids and proteins prepared by recombinant expression in a host cell as well as chemically synthesized nucleic acids.

Label: Detectable marker or reporter molecules, which can be attached to nucleic acids. Typical labels include fluorophores, radioactive isotopes, ligands, chemiluminescent agents, metal sols and colloids, and enzymes. Methods for labeling and guidance in the choice of labels useful for various purposes are discussed, e.g., in Sambrook et al., in *Molecular Cloning: A Laboratory Manual*, Cold Spring Harbor Laboratory Press (1989) and Ausubel et al., in *Current Protocols in Molecular Biology*, Greene Publishing Associates and Wiley-Intersciences (1987).

Mutation: Any change of the DNA sequence within a gene or chromosome. In some instances, a mutation will alter a characteristic or trait (phenotype), but this is not always the case. Types of mutations include base substitution point mutations (e.g., transitions or transversions), deletions, and insertions. Missense mutations are those that introduce a different amino acid into the sequence of the encoded protein; nonsense mutations are those that introduce a new stop codon. In the case of insertions or deletions, mutations can be in-frame (not changing the frame of the overall sequence) or frame shift mutations, which may result in the misreading of a large number of codons (and often leads to abnormal termination of the encoded product due to the presence of a stop codon in the alternative frame).

This term specifically encompasses variations that arise through somatic mutation, for instance those that are found only in disease cells, but not constitutionally, in a given individual. Examples of such somatically-acquired variations include the point mutations that frequently result in altered function of various genes that are involved in development of cancers. This term also encompasses DNA alterations that are present constitutionally, that alter the function of the encoded protein in a readily demonstrable manner, and that can be inherited by the children of an affected individual. In this respect, the term overlaps with "polymorphism," as defined below, but generally refers to the subset of constitutional alterations.

Nucleic acid: A deoxyribonucleotide or ribonucleotide polymer in either single or double stranded form, and unless otherwise limited, encompassing known analogues of natural nucleotides that hybridize to nucleic acids in a manner similar to naturally occurring nucleotides.

Nucleic acid array: An arrangement of nucleic acids (such as DNA or RNA) in assigned locations on a matrix, such as that found in cDNA arrays, or oligonucleotide arrays.

Nucleic acid molecules representing genes: Any nucleic acid, for example DNA (intron or exon or both), cDNA or RNA, of any length suitable for use as a probe or other indicator molecule, and that is informative about the corresponding gene.

Nucleotide: "Nucleotide" includes, but is not limited to, a monomer that includes a base linked to a sugar, such as a pyrimidine, purine or synthetic analogs thereof, or a base linked to an amino acid, as in a peptide nucleic acid (PNA). A nucleotide is one monomer in a polynucleotide. A nucleotide sequence refers to the sequence of bases in a polynucleotide.

Oligonucleotide: A linear single-stranded polynucleotide sequence ranging in length from 2 to about 5,000 bases, for example a polynucleotide (such as DNA or RNA) which is at least 6 nucleotides, for example at least 10, 12, 15, 18, 20, 25, 50, 100, 200, 1,000, or even 5,000 nucleotides long. Oligonucleotides are often synthetic but can also be produced from naturally occurring polynucleotides.

An oligonucleotide analog refers to moieties that function similarly to oligonucleotides but have non-naturally occurring portions. For example, oligonucleotide analogs can contain non-naturally occurring portions, such as altered sugar moieties or inter-sugar linkages, such as a phosphorothioate oligodeoxynucleotide. Functional analogs of naturally occurring polynucleotides can bind to RNA or DNA, and include peptide nucleic acid (PNA) molecules. Such analog molecules may also bind to or interact with polypeptides or proteins.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame.

Open reading frame (ORF): A series of nucleotide triplets (codons) coding for amino acids without any internal termination codons. These sequences are usually translatable into a peptide.

Peptide Nucleic Acid (PNA): An oligonucleotide analog with a backbone comprised of monomers coupled by amide (peptide) bonds, such as amino acid monomers joined by peptide bonds.

Pharmaceutically acceptable carriers: The pharmaceutically acceptable carriers useful with compositions provided herein are conventional. By way of example, Martin, in *Remington's Pharmaceutical Sciences*, published by Mack Publishing Co., Easton, Pa., 19th Edition, 1995, describes compositions and formulations suitable for pharmaceutical delivery of the nucleotides and proteins herein disclosed.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Polymorphism: Variant in a sequence of a gene, usually carried from one generation to another in a population. Polymorphisms can be those variations (nucleotide sequence differences) that, while having a different nucleotide sequence, produce functionally equivalent gene products, such as those variations generally found between individuals, different ethnic groups, geographic locations. The term polymorphism also encompasses variations that produce gene products with altered function, i.e., variants in the gene sequence that lead to gene products that are not functionally equivalent. This term also encompasses variations that produce no gene product, an inactive gene product, or increased or increased activity gene product.

Polymorphisms can be referred to, for instance, by the nucleotide position at which the variation exists, by the change in amino acid sequence caused by the nucleotide variation, or by a change in some other characteristic of the nucleic acid molecule or protein that is linked to the variation (e.g., an alteration of a secondary structure such as a stem-loop, or an alteration of the binding affinity of the nucleic acid for associated molecules, such as polymerases, RNases, and so forth).

Probes and primers: Nucleic acid probes and primers can be readily prepared based on the nucleic acid molecules provided as indicators of taste reception or likely taste reception. It is also appropriate to generate probes and primers based on fragments or portions of these nucleic acid molecules, particularly in order to distinguish between and among different alleles and haplotypes within a single gene. Also appropriate are probes and primers specific for the reverse complement of these sequences, as well as probes and primers to 5' or 3' regions.

A probe comprises an isolated nucleic acid attached to a detectable label or other reporter molecule. Typical labels include radioactive isotopes, enzyme substrates, co-factors, ligands, chemiluminescent or fluorescent agents, haptens, and enzymes. Methods for labeling and guidance in the choice of labels appropriate for various purposes are discussed, e.g., in Sambrook et al. (In *Molecular Cloning: A Laboratory Manual*, CSHL, New York, 1989) and Ausubel et al. (In *Current Protocols in Molecular Biology*, John Wiley & Sons, New York, 1998).

Primers are short nucleic acid molecules, for instance DNA oligonucleotides 10 nucleotides or more in length. Longer DNA oligonucleotides may be about 15, 20, 25, 30 or 50 nucleotides or more in length. Primers can be annealed to a complementary target DNA strand by nucleic acid hybridization to form a hybrid between the primer and the target DNA strand, and then the primer extended along the target DNA strand by a DNA polymerase enzyme. Primer pairs can be used for amplification of a nucleic acid sequence, e.g., by the polymerase chain reaction (PCR) or other in vitro nucleic-acid amplification methods known in the art.

Methods for preparing and using nucleic acid probes and primers are described, for example, in Sambrook et al. (In *Molecular Cloning: A Laboratory Manual*, CSHL, New York, 1989), Ausubel et al. (ed.) (In *Current Protocols in Molecular Biology*, John Wiley & Sons, New York, 1998), and Innis et al. (*PCR Protocols, A Guide to Methods and Applications*, Academic Press, Inc., San Diego, Calif., 1990). Amplification primer pairs (for instance, for use with polymerase chain reaction amplification) can be derived from a known sequence such as any of the bitter taste receptor sequences and specific alleles thereof described herein, for example, by using computer programs intended for that purpose such as PRIMER (Version 0.5, © 1991, Whitehead Institute for Biomedical Research, Cambridge, Mass.).

One of ordinary skill in the art will appreciate that the specificity of a particular probe or primer increases with its length. Thus, for example, a primer comprising 30 consecutive nucleotides of a bitter taste receptor protein encoding nucleotide will anneal to a target sequence, such as homolog of a designated taste receptor protein, with a higher specificity than a corresponding primer of only 15 nucleotides. Thus, in order to obtain greater specificity, probes and primers can be selected that comprise at least 20, 23, 25, 30, 35, 40, 45, 50 or more consecutive nucleotides of a taste receptor gene.

Also provided are isolated nucleic acid molecules that comprise specified lengths of bitter taste receptor-encoding nucleotide sequences. Such molecules may comprise at least 10, 15, 20, 23, 25, 30, 35, 40, 45 or 50 or more (e.g., at least 100, 150, 200, 250, 300 and so forth) consecutive nucleotides of these sequences or more. These molecules may be obtained from any region of the disclosed sequences (e.g., a specified nucleic acid may be apportioned into halves or quarters based on sequence length, and isolated nucleic acid molecules may be derived from the first or second halves of the molecules, or any of the four quarters, etc.). A cDNA or other encoding sequence also can be divided into smaller regions, e.g. about eighths, sixteenths, twentieths, fiftieths, and so forth, with similar effect.

Another mode of division, provided by way of example, is to divide a bitter taste receptor sequence based on the regions of the sequence that are relatively more or less homologous to other bitter taste receptor sequences.

Nucleic acid molecules may be selected that comprise at least 10, 15, 20, 25, 30, 35, 40, 50, 100, 150, 200, 250, 300 or more consecutive nucleotides of any of these or other portions of a bitter taste receptor nucleic acid molecule or a specific allele thereof, such as those disclosed herein. Thus, representative nucleic acid molecules might comprise at least 10 consecutive nucleotides of the bitter taste receptor nucleic acid coding sequence shown in any one of SEQ ID NOs: 1, 3, 5, 7, 9, 11, 13, 15, 17, 19, 21, 23, 25, 27, 29, 31, 33, 35, 39, 41, or 45 (indicating variable SNP positions), or SEQ ID NOs: 47-233 (odd numbered sequences). More particularly, probes and primers in some embodiments are selected so that they overlap or reside adjacent to at least one of the indicated SNPs indicated in the Sequence Listing or in FIG. 1 or Table 7

Purified: The term purified does not require absolute purity; rather, it is intended as a relative term. Thus, for example, a purified nucleic acid preparation is one in which the specified protein is more enriched than the nucleic acid is in its generative environment, for instance within a cell or in a biochemical reaction chamber. A preparation of substantially pure nucleic acid may be purified such that the desired nucleic acid represents at least 50% of the total nucleic acid content of the preparation. In certain embodiments, a substantially pure nucleic acid will represent at least 60%, at least 70%, at least 80%, at least 85%, at least 90%, or at least 95% or more of the total nucleic acid content of the preparation.

Recombinant: A recombinant nucleic acid is one that has a sequence that is not naturally occurring or has a sequence that is made by an artificial combination of two otherwise separated segments of sequence. This artificial combination can be accomplished by chemical synthesis or, more commonly, by the artificial manipulation of isolated segments of nucleic acids, e.g., by genetic engineering techniques.

RNA: A typically linear polymer of ribonucleic acid monomers, linked by phosphodiester bonds. Naturally occurring RNA molecules fall into three classes, messenger (mRNA, which encodes proteins), ribosomal (rRNA, components of ribosomes), and transfer (tRNA, molecules responsible for transferring amino acid monomers to the ribosome during protein synthesis). Total RNA refers to a heterogeneous mixture of all three types of RNA molecules.

Sequence identity: The similarity between two nucleic acid sequences, or two amino acid sequences, is expressed in terms of the similarity between the sequences, otherwise referred to as sequence identity. Sequence identity is frequently measured in terms of percentage identity (or similarity or homology); the higher the percentage, the more similar the two sequences are. Homologs or orthologs of nucleic acid or amino acid sequences will possess a relatively high degree of sequence identity when aligned using standard methods. This homology will be more significant when the orthologous proteins or nucleic acids are derived from species which are more closely related (e.g., human and chimpanzee sequences), compared to species more distantly related (e.g., human and *C. elegans* sequences). Typically, orthologs are at least 50% identical at the nucleotide level and at least 50% identical at the amino acid level when comparing human orthologous sequences.

Methods of alignment of sequences for comparison are well known. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, Gene, 73:237-44, 1988; Higgins & Sharp, CABIOS 5:151-3, 1989; Corpet et al., *Nuc. Acids Res.* 16:10881-90, 1988; Huang et al. *Computer Appls. Biosci.* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

The NCBI Basic Local Alignment Search Tool (BLAST) (Altschul et al., *J. Mol. Biol.* 215:403-10, 1990) is available from several sources, including the National Center for Biotechnology Information (NCBI, Bethesda, Md.) and on the Internet, for use in connection with the sequence analysis programs blastp, blastn, blastx, tblastn and tblastx. Each of these sources also provides a description of how to determine sequence identity using this program.

Homologous sequences are typically characterized by possession of at least 60%, 70%, 75%, 80%, 90%, 95% or at least 98% sequence identity counted over the full length alignment with a sequence using the NCBI Blast 2.0, gapped blastp set to default parameters. Queries searched with the blastn program are filtered with DUST (Hancock and Armstrong, *Comput. Appl. Biosci.* 10:67-70, 1994). It will be appreciated that these sequence identity ranges are provided for guidance only; it is entirely possible that strongly significant homologs could be obtained that fall outside of the ranges provided.

Nucleic acid sequences that do not show a high degree of identity may nevertheless encode similar amino acid sequences, due to the degeneracy of the genetic code. It is understood that changes in nucleic acid sequence can be made using this degeneracy to produce multiple nucleic acid sequences that all encode substantially the same protein.

An alternative indication that two nucleic acid molecules are closely related is that the two molecules hybridize to each other under stringent conditions, as described under "specific hybridization."

Single Nucleotide Polymorphism (SNP): A single base (nucleotide) difference in a specific location in the DNA sequence among individuals in a population. A subset of SNPs give rise to changes in the encoded amino acid sequence; these are referred to as coding SNPs, or cSNPs.

Specific binding agent: An agent that binds substantially only to a defined target. Thus a protein-specific binding agent binds substantially only the specified protein. By way of example, as used herein, the term "X-protein specific binding agent" includes anti-X protein antibodies (and functional fragments thereof) and other agents (such as soluble receptors) that bind substantially only to the X protein (where "X" is a specified protein, or in some embodiments a specified domain or form of a protein, such as a particular allelic form of a protein).

Anti-X protein antibodies may be produced using standard procedures described in a number of texts, including Harlow and Lane (*Antibodies, A Laboratory Manual*, CSHL, New York, 1988). The determination that a particular agent binds substantially only to the specified protein may readily be made by using or adapting routine procedures. One suitable in vitro assay makes use of the Western blotting procedure (described in many standard texts, including Harlow and Lane (*Antibodies, A Laboratory Manual*, CSHL, New York, 1988)). Western blotting may be used to determine that a given protein binding agent, such as an anti-X protein monoclonal antibody, binds substantially only to the X protein.

Shorter fragments of antibodies can also serve as specific binding agents. For instance, Fabs, Fvs, and single-chain Fvs (SCFvs) that bind to a specified protein would be specific binding agents. These antibody fragments are defined as follows: (1) Fab, the fragment which contains a monovalent antigen-binding fragment of an antibody molecule produced by digestion of whole antibody with the enzyme papain to yield an intact light chain and a portion of one heavy chain; (2) Fab', the fragment of an antibody molecule obtained by treating whole antibody with pepsin, followed by reduction, to yield an intact light chain and a portion of the heavy chain; two Fab' fragments are obtained per antibody molecule; (3) (Fab')$_2$, the fragment of the antibody obtained by treating whole antibody with the enzyme pepsin without subsequent reduction; (4) F(ab')$_2$, a dimer of two Fab' fragments held together by two disulfide bonds; (5) Fv, a genetically engineered fragment containing the variable region of the light chain and the variable region of the heavy chain expressed as two chains; and (6) single chain antibody ("SCA"), a genetically engineered molecule containing the variable region of the light chain, the variable region of the heavy chain, linked by a suitable polypeptide linker as a genetically fused single chain molecule. Methods of making these fragments are routine.

Specific hybridization: Specific hybridization refers to the binding, duplexing, or hybridizing of a molecule only or substantially only to a particular nucleotide sequence when that sequence is present in a complex mixture (e.g. total cellular DNA or RNA). Specific hybridization may also occur under conditions of varying stringency.

Hybridization conditions resulting in particular degrees of stringency will vary depending upon the nature of the hybridization method of choice and the composition and length of the hybridizing DNA used. Generally, the temperature of hybridization and the ionic strength (especially the Na+ concentration) of the hybridization buffer will determine the stringency of hybridization. Calculations regarding hybridization conditions required for attaining particular degrees of stringency are discussed by Sambrook et al. (In: *Molecular Cloning: A Laboratory Manual*, Cold Spring Harbor, New York, 1989 ch. 9 and 11). By way of illustration only, a hybridization experiment may be performed by hybridization of a DNA molecule to a target DNA molecule which has been electrophoresed in an agarose gel and transferred to a nitrocellulose membrane by Southern blotting (Southern, *J. Mol. Biol.* 98:503, 1975), a technique well known in the art and described in Sambrook et al. (*Molecular Cloning: A Laboratory Manual*, Cold Spring Harbor, New York, 1989).

Traditional hybridization with a target nucleic acid molecule labeled with [$^{32}$P]-dCTP is generally carried out in a solution of high ionic strength such as 6×SSC at a temperature that is 20-25° C. below the melting temperature, $T_m$, described below. For Southern hybridization experiments where the target DNA molecule on the Southern blot contains 10 ng of DNA or more, hybridization is typically carried out for 6-8 hours using 1-2 ng/ml radiolabeled probe (of specific activity equal to 10$^9$ CPM/μg or greater). Following hybridization, the nitrocellulose filter is washed to remove background hybridization. The washing conditions should be as stringent as possible to remove background hybridization but to retain a specific hybridization signal.

The term $T_m$ represents the temperature (under defined ionic strength, pH and nucleic acid concentration) at which 50% of the probes complementary to the target sequence hybridize to the target sequence at equilibrium. Because the target sequences are generally present in excess, at $T_m$ 50% of the probes are occupied at equilibrium. The $T_m$ of such a hybrid molecule may be estimated from the following equation (Bolton and McCarthy, *Proc. Natl. Acad. Sci. USA* 48:1390, 1962):

$$T_m = 81.5° C. - 16.6(\log_{10}[Na^+]) + 0.41(\% G+C) - 0.63(\% \text{formamide}) - (600/l)$$

where l=the length of the hybrid in base pairs.

This equation is valid for concentrations of Na$^+$ in the range of 0.01 M to 0.4 M, and it is less accurate for calculations of Tm in solutions of higher [Na$^+$]. The equation is also primarily valid for DNAs whose G+C content is in the range of 30% to 75%, and it applies to hybrids greater than 100 nucleotides in length (the behavior of oligonucleotide probes is described in detail in Ch. 11 of Sambrook et al. (*Molecular Cloning: A Laboratory Manual*, Cold Spring Harbor, N.Y., 1989).

Thus, by way of example, for a 150 base pair DNA probe derived from a cDNA (with a hypothetical % GC of 45%), a calculation of hybridization conditions required to give particular stringencies may be made as follows: For this example, it is assumed that the filter will be washed in 0.3× SSC solution following hybridization, thereby: [Na+]=0.045 M; %GC=45%; Formamide concentration=0; 1=150 base pairs; Tm=81.5−16.6(log$_{10}$[Na+])+(0.41×45)−(600/150); and so Tm=74.4° C.

The T$_m$ of double-stranded DNA decreases by 1-1.5° C. with every 1% decrease in homology (Bonner et al., *J. Mol. Biol.* 81:123, 1973). Therefore, for this given example, washing the filter in 0.3×SSC at 59.4-64.4° C. will produce a stringency of hybridization equivalent to 90%; that is, DNA molecules with more than 10% sequence variation relative to the target cDNA will not hybridize. Alternatively, washing the hybridized filter in 0.3×SSC at a temperature of 65.4-68.4° C. will yield a hybridization stringency of 94%; that is, DNA molecules with more than 6% sequence variation relative to the target cDNA molecule will not hybridize. The above example is given entirely by way of theoretical illustration. It will be appreciated that other hybridization techniques may be utilized and that variations in experimental conditions will necessitate alternative calculations for stringency.

Stringent conditions may be defined as those under which DNA molecules with more than 25%, 15%, 10%, 6% or 2% sequence variation (also termed "mismatch") will not hybridize. Stringent conditions are sequence dependent and are different in different circumstances. Longer sequences hybridize specifically at higher temperatures. Generally, stringent conditions are selected to be about 5° C. lower than the thermal melting point T$_m$ for the specific sequence at a defined ionic strength and pH. An example of stringent conditions is a salt concentration of at least about 0.01 to 1.0 M Na ion concentration (or other salts) at pH 7.0 to 8.3 and a temperature of at least about 30° C. for short probes (e.g. 10 to 50 nucleotides). Stringent conditions can also be achieved with the addition of destabilizing agents such as formamide. For example, conditions of 5×SSPE (750 mM NaCl, 50 mM Na Phosphate, 5 mM EDTA, pH 7.4) and a temperature of 25-30° C. are suitable for allele-specific probe hybridizations.

A perfectly matched probe has a sequence perfectly complementary to a particular target sequence. The test probe is typically perfectly complementary to a portion (subsequence) of the target sequence. The term "mismatch probe" refers to probes whose sequence is deliberately selected not to be perfectly complementary to a particular target sequence.

Transcription levels can be quantitated absolutely or relatively. Absolute quantitation can be accomplished by inclusion of known concentrations of one or more target nucleic acids (for example control nucleic acids or with a known amount the target nucleic acids themselves) and referencing the hybridization intensity of unknowns with the known target nucleic acids (for example by generation of a standard curve).

Subject: Living, multicellular vertebrate organisms, a category that includes both human and veterinary subjects for example, mammals, birds and primates.

Transformed: A transformed cell is a cell into which has been introduced a nucleic acid molecule by molecular biology techniques. As used herein, the term transformation encompasses all techniques by which a nucleic acid molecule might be introduced into such a cell, including transfection with viral vectors, transformation with plasmid vectors, and introduction of naked DNA by electroporation, lipofection, and particle gun acceleration.

Vector: A nucleic acid molecule as introduced into a host cell, thereby producing a transformed host cell. A vector may include nucleic acid sequences that permit it to replicate in a host cell, such as an origin of replication. A vector may also include one or more selectable marker genes and other genetic elements known in the art.

Unless otherwise explained, all technical and scientific terms used herein have the same meaning as commonly understood by one of ordinary skill in the art to which this invention belongs. The singular terms "a," "an," and "the" include plural referents unless context clearly indicates otherwise. Similarly, the word "or" is intended to include "and" unless the context clearly indicates otherwise. Hence "comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

III. Overview, Variants of Human Taste Receptor Genes

The inventors herein have discovered many novel polymorphic sites (polymorphisms, SNPs) in the T2R genes. These SNPs are listed in FIG. 1. In addition, the inventors have determined the haplotypes for 22 of the T2R genes; these haplotypes are listed in Table 7. The haplotypes were identified from related individuals from the Utah Genetic Reference Project (consisting of individuals of Northern European ancestry), unrelated individuals from the NIH (of European, Asian, African American, and Native American ancestry), and unrelated individuals in five different geographic populations, including Cameroonians, Amerindians, Japanese, Hungarians, and Pygmies. Distributions and frequency of SNPs and haplotypes in the various populations are shown below, for instance in Tables 2, 3, 4, and 5B (SNPs and haplotypes for T2R38), and Table 7B (haplotypes for 22 T2R genes). Each of the identified T2R haplotypes defines a naturally occurring variant (isoforms) of the corresponding T2R gene that exists in a human population.

Thus, in one embodiment there are provided methods, compositions and kits for genotyping one or more T2R gene(s) in an individual. The genotyping method comprises identifying the nucleotide pair that is present at one or more variant sites selected from the group listed in FIG. 1, in both copies of the selected T2R gene(s) from the individual. Examples of such methods further comprise identifying the nucleotide pairs at all variant sites within any one T2R gene. Specific contemplated genotyping compositions comprise an oligonucleotide probe or primer that overlaps and is designed to specifically hybridize to a target region containing, or adjacent to, one of the listed T2R SNP sites, for instance specifically one of the SNPs that is referred to in FIG. 1 as newly identified by the inventors. A representative genotyping kit comprises one or more oligonucleotide(s) designed to genotype one or more of the T2R SNP sites. Examples of such kits include at least one oligonucleotide designed to genotype a single T2R gene at all identified SNP sites (which is also useful in haplotying the individual). Other examples of such kits include at least one oligonucleotide designed to genotype at least one SNP within each of the 23 provided T2R genes.

One specific example is a kit that comprises at least one oligonucleotide designed to genotype each and every SNP described herein. The provided genotyping methods, compositions, and kits are useful, for instance, for identifying an individual, or collection of individuals, that has one of the genotypes or haplotypes described herein.

Also provided herein are methods for haplotyping 22 T2R genes, singly or in combination with two or more of the set, in an individual. In examples of such methods, the method comprises determining, the identity of the nucleotide at one or more SNP sites (such as those listed in FIG. 1) for one copy or both copies (also referred to as diplotyping) of the chosen T2R gene(s). In specific examples of such methods, it is determined whether at least one copy of at least one T2R gene in the individual's AGTR1 gene corresponds to one of the haplotypes shown in Table 7, below.

It is specifically contemplated that more than one T2R gene can be haplotyped (or genotyped) in the individual. By way of example, all of the T2R genes listed herein (T2R1, T2R3, T2R4, T2R5, T2R7, T2R8, T2R9, T2R10, T2R13, T2R14, T2R16, T2R38, T2R39, T2R40, T2R41, T2R43, T2R44, T2R45, T2R46, T2R47, T2 R48, T2R49, T2R50, and T2R60) may be haplotyped (or genotyped at one or more SNP positions) in a single individual. Alternatively, any subset of T2R genes may be haplotyped/genotyped.

For example, the haplotyping method can be used to validate a specific T2R protein, or isoform (as defined by the provided haplotypes) as a candidate target for a ligand, such as a bitter tasting compound, or a blocker or other compound that interferes with or influences perception of bitter taste. Determining for a particular population the frequency of one or more of the individual T2R haplotypes or haplotype pairs described herein will facilitate a decision on whether to pursue it as a target for influencing taste perception, for instance to alter medicine, food or drink preparations, in a way particularly suited to a given population.

If variable T2R activity or tastant binding is associated with perception of (or failure to perceive) a bitter tastant, then one or more T2R haplotypes or haplotype pairs is expected to be found at a higher frequency in taster (or non-taster) cohorts than in appropriately genetically matched control individuals. This is illustrated herein with the T2R38 gene (also referred to as the PTC receptor). The practitioner or other individual, without a priori knowledge as to the phenotypic effect of any specific T2R haplotype or haplotype pair, can apply the information derived from detecting T2R haplotypes in an individual to decide whether modulating activity of the chosen T2R would be expected to be useful in influencing taste in an individual or a population. Various methods are provided herein for testing whether a compound or ligand interacts with a specific T2R isoform/variant, including ex vivo systems and in vivo systems. Some of these systems measure perceived taste or changes thereto directly; others measure an upstream signal for taste perception, such as for instance release of intracellular calcium based on the activity of the T2R or another protein in the taste perception pathway.

The provided T2R SNPs and haplotypes are also useful in screening for compounds targeting a T2R (or family of T2R) protein to influence a phenotype associated with the T2R isoform, such as perception of a taste such as a bitter taste. For example, detecting which of the T2R haplotypes disclosed herein are present in individual members of a target population with enables the practitioner or other individual to screen for a compound(s) that displays the highest desired agonist or antagonist activity for each of the T2R isoforms present in the target population, or the most common isoforms present in the target population. Thus, without requiring any a priori knowledge of the phenotypic effect of any particular T2R haplotype, the provided haplotyping methods provide the practitioner or other individual with a tool to identify lead compounds that are more likely to show efficacy in influencing taste perception.

The method for haplotyping one or more T2R gene(s) in an individual is also useful in the design of trials of candidate compounds for influencing perception of taste, particularly bitter taste, that predicted to be associated with T2R activity. For example, instead of randomly assigning subjects to the test or control group as is typically done now, determining which of the T2R haplotype(s) disclosed herein are present in individuals in the study enables one to select the distribution of T2R haplotypes and/or sets or T2R haplotypes to test and control groups, thereby controlling any possible bias in the results that could be introduced by a larger frequency of any one T2R haplotype or set of haplotypes that had a previously unknown association with response to the tastant or other ligand being studied. Thus, with the information provided herein, one can more confidently rely on the results of the trial, without needing to first determine the specific phenotypic effect of any T2R haplotype or haplotype pair.

Another embodiment provides a method for identifying an association between a trait and a T2R genotype, haplotype, or set of haplotypes for one or more of the T2R genes described herein. The method comprises comparing the frequency of the T2R genotype, haplotype, or set of haplotypes in a population exhibiting the trait (e.g., taste recognition of a compound, or activation of the target T2R isoform) with the frequency of the T2R genotype or haplotype in a reference population. A higher frequency of the T2R genotype, haplotype, or set of haplotypes in the population having the trait than in the reference population indicates the trait is associated with the T2R genotype, haplotype, or set of haplotypes. In examples of such methods, the T2R SNP is selected from a SNP indicated in FIG. 1 as being newly identified by the inventors, or the T2R haplotype is selected from the haplotypes shown in Table 7. Such methods have applicability, for instance, in developing diagnostic tests for taste perception and development and identification of compounds useful for influencing taste, particularly perception of bitter taste, for instance in a specific target population.

Yet another embodiment is an isolated polynucleotide comprising a nucleotide sequence which is a polymorphic variant (allele) of a reference sequence for a T2R gene, or a fragment thereof, particularly a fragment of 10 or more contiguous nucleotides that overlap a SNP identified herein. The reference sequence for each T2R gene is indicated by GenBank Accession number herein, for instance in the brief description of Sequence Listing. Polymorphisms in T2R genes are indicated in FIG. 1, and particularly relevant are those SNPs indicated as new in that figure. Specific contemplated herein are isolated nucleic acid molecules that comprise a nucleotide sequence for a T2R allele, wherein the nucleotide sequence is selected from SEQ ID NO: 3, 7, 9, 11, 13, 15, 19, 21, 23, 25, 27, 29, 31, 33, 35, 39, 41, 45, 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, or 263.

Other embodiments provide recombinant expression vectors comprising at least one of the T2R allele variants operably linked to expression regulatory elements, and recombinant host cells transformed or transfected with such an expression vector. The recombinant vector and host cell may be used, for instance, to express a T2R isoform for protein structure analysis and compound binding studies, as discussed more fully herein.

Also provided are T2R polypeptide isoforms, which comprise a polymorphic variant of a reference amino acid sequence for a T2R protein. The reference sequence for each T2R protein is indicated by GenBank Accession number herein, for instance in the brief description of Sequence Listing. Polymorphisms in T2R proteins are indicated in FIG. 1, and particularly relevant are those cSNPs indicated as new in that figure, which cause a change in the protein sequence and therefore result in a new T2R isoform. T2R variants are useful in studying the effect of the variation on the biological activity of the T2R, as well as on the binding affinity of candidate compounds (e.g., tastants) targeting T2R for influence perception of bitter taste.

Also provided are T2R sequence anthologies, which are collections of T2R alleles or isoforms found in a selected population. The population may be any group of at least two individuals, including but not limited to a reference population, a target population, a geographic population (e.g., based on continent, country, region, and so forth), a family population, a clinical population, and a sex-selected population. A T2R sequence anthology may comprise individual T2R haplotype nucleic acid molecules stored in separate containers such as tubes, separate wells of a microtiter plate and the like. Individual allele nucleic acid molecules or isoforms, or groups of such molecules, in a T2R sequence anthology, may be stored in any convenient and stable form, including but not limited to in buffered solutions, as DNA precipitates, freeze-dried preparations and the like. A specific contemplated T2R sequence anthology comprises the set of haplotypes (or the encoded isoforms) shown in Table 7A. Also contemplated are anthologies that comprise subsets of T2R sequences, such as for instance a set of all of the haplotypes (or encoded isoforms) for a single T2R gene, or a set of at least one haplotype (or encoded isoform) for each T2R gene, and so forth.

Another embodiment provides specific binding agents, such as antibodies, that recognize and specifically bind to one of the variant T2R proteins described herein.

Yet another embodiment is a nonhuman transgenic animal, comprising at least one polymorphic genomic T2R variant allele described herein, as well as methods for producing such animals. The transgenic animals are useful for studying expression of the T2R isoforms in vivo, for screening and testing of compositions targeted against the T2R protein, and for analyzing the effectiveness of agents and compounds for influencing taste, for instance blocking bitter taste, in a biological system.

Yet another embodiment is a computer system for storing and displaying polymorphism, and particularly haplotype, data determined for T2R genes as described herein. A typical computer system includes a computer processing unit, a display, and a database containing the data. Representative T2R polymorphism data includes T2R SNPs (such as those listed in FIG. 1), T2R genotypes, T2R haplotypes (such as those listed in Table 7) and population or other information about the individuals in one or more populations.

IV. Representative Uses of T2R SNPs and Haplotypes

Identifying receptor-ligand relationships has been difficult and the nature of the ligand that binds to each receptor and initiates bitter taste perception is known for only a few of these receptors. In humans, in vitro studies have shown that T2R16 responds to salicin and other beta-glucopyranosides and T2R10 to strychnine, while using an alternative human genetic approach has revealed that T2R38 encodes the receptor for phenylthiocarbamide (PTC), a classic variant trait in humans. Distinct phenotypes have been clearly associated only with specific haplotypes of the PTC receptor and there are now five SNPs described corresponding to seven haplotypes, including taster, non-taster and intermediate alleles (see, e.g., PCT/US02/23172, published as WO 03/008627, which is incorporated herein by reference). The non-taster allele may encode an isoform that serves as a functional receptor for another as yet unidentified toxic bitter substance. T2R38 (PTC) studies suggest that there may be substantial additional complexity in the task of identifying specific ligands for each bitter taste receptor, as different alleles of each gene may encode receptors that recognize different ligands. However merely identifying in isolation the many different DNA variants (SNPs) in these genes is less useful as these variants could possibly exist in a huge number of different genetically-linked combinations (haplotypes) able to encode a correspondingly huge number of bitter taste receptors expressed on the surface of the tongue. (The number of different possible proteins increases as the number (N) of different cSNPs (SNPs able to give rise to changes in amino acid sequence) in the coding sequence of the gene by $2^N$, where N is the number of different cSNPs in the coding sequence of the gene.)

Thus, the identification of T2R haplotypes provided herein is important because the individual sequence variants (SNPs) in isolation do not determine the receptor protein produced in a cell. For example, the three variant sites in T2R38 are capable of producing eight different protein isoforms, depending on the combination of variant forms present at each of the three sites ($2^3$=eight potential haplotype sequences). In reality, those three sites produce only five different haplotypes; three possible haplotypes do not exist in any population worldwide insofar as we can determine. This becomes particularly important when a gene contains many coding sequence variants, such as T2R49. There are eleven different coding SNP's in this gene, which could occur together in over 2000 possible combinations, potentially producing over 2000 different forms of the T2R49 receptor protein. In fact, as described herein, there are only seven identified haplotypes, and thus only seven out of the 2000 different receptor forms for this gene actually exist in humans. In the 22 T2R genes analyzed, we have identified a total of 109 different protein coding haplotypes, and thus 109 different isoforms of the T2R proteins.

It is believed that different T2R haplotypes encode receptor isoforms with different chemical specificities for bitter tastants/ligands, analogous to the situation we have shown exists for T2R38. Efforts are currently ongoing worldwide to identify bitter tastants/ligands for each receptor. The results presented herein indicate that this cannot be viewed as an effort to decode ligands for only 22 or 23 different T2R genes. Instead the real nature of the problem is to decode the ligand(s) for each of at least 109 different haplotypes. Experiments to identify ligand(s) (or blockers) for all possible haplotypes (which number many thousands, counting all 23 T2R genes together) are not practicable with current technologies, nor are they necessary if the vast majority of possible haplotypes/isoforms do not in fact occur in nature. Our information reveals the subset of possible haplotype sequences that are actually present in humans, and are thus worthy of further study. This will enable more rapid and efficient de-orphanizing of each of the taste receptors, as we have done for T2R38.

Also reported herein are T2R haplotype frequencies in each of several populations, including Europeans, East Asians, and Africans. This information can be used to design foods and beverages for different worldwide markets, in two ways. First, in food and beverage research and development, population-specific haplotype distribution information will allow the selection of panels of taste sensors in a rational and efficient manner. This information will also be useful in either pure in vitro systems, or in panels of human volunteer tasters, who can be genotyped or selected using these discoveries. Second, knowledge of the genetic underpinnings in individual taste preferences in target populations will provide powerful predictive information for food and beverage palatability in different populations. Thus population-specific, and indeed even region-specific, anthologies or databases are now able to be developed using this information; these can provide T2R haplotype frequencies in regional or local populations. These resources can be used to improve both development and marketing decisions in the flavorings, food, and beverages industries.

Also provided based on the discoveries described herein are methods and devices for high throughput analysis of T2R genotype and/or phenotype in an individual or group of individuals. A specific example of such a high throughput device is a DNA or protein microarray, which contains a collection of two or more T2R alleles or SNP-specific oligonucleotides (in the case of a DNA microarray) or isoform proteins or variant fragments thereof (in the case of a protein microarray). Examples of such arrays of molecules include at least one molecule representing each of the 109 haplotypes listed in Table 7A. Specific example arrays include at least two sequences selected from SEQ ID NOs: 3, 7, 9, 11, 13, 15, 19, 21, 23, 25, 27, 29, 31, 33, 35, 39, 41, 45, 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, and 263, or an oligonucleotide comprising at least 6 or at least 10 contiguous nucleotides selected from one of these sequences and which oligonucleotide overlaps at least one SNP as listed in FIG. 1. Other specific example arrays include at least five such sequences, at least 10, at least 20, at least 30, at least 50 or more, including for instance all 81 of the following: SEQ ID NOs: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, and 263, or an oligonucleotide fragment of each of these sequences which oligonucleotide overlaps at least one SNP form the sequence.

By way of example, such arrays can be used in genotyping and haplotyping of individuals or groups of individuals. In certain embodiments, the results from such genotyping/haplotyping is used to select a cohort of individuals of known genotype/haplotype for at least one T2R receptor (or a combination of two or more T2R receptors, or all T2R receptors). These individuals could then be trained (as necessary) and used in flavor panel evaluation. Because the population of taste evaluators are of known (or partially known) genotype as relates to T2R receptor(s), a relatively small panel of tasters can provide results that can be extrapolated out to a large (e.g., commercially relevant) population. Such large population is beneficially characterized by the frequency of occurrence of specific T2R isoforms/haplotypes, so that panels can be matched to the expected taste preference(s) of the population. The teachings herein enable such methods of extrapolating the bitter taste receptor haplotype from a small group to a large (commercially relevant) population, thus representing a savings in time and cost. Such an approach could be used, for instance, for "deorphanising" T2R receptors for specific bitter tastes/tastants or combinations thereof, for evaluating likely population response to tastants or blockers, or to characterize or develop new tastant molecules or blockers. This would allow decisions about population-specific taste variation to aid decisions about worldwide marketing of specific flavorings and food and beverage products.

Also contemplated are in vitro biochemical functional assays of T2R taste receptor function. Such studies employ a variety of different assays, which produce information about G protein activation upon binding of tastant ligands to T2R receptors. One long term goal of such studies is the development of an "artificial tongue" that could be used to perform taste tests without the intervention of living humans as taste sensors.

V. Ex vivo uses of T2R Bitter Receptor Haplotype-Specific Isoforms

These haplotypes can be used to make protein expression constructions and generate 109 unique T2R bitter receptor proteins. These proteins can be arranged in a battery or an array to create a group of sensors for bitter tastants ligands. Such an array could be employed in large parallel high-throughput systems, that would allow the testing of the effects of bitter tastant ligands on all forms of all receptors without the intervention of human tasters.

These expressed isoform receptors can be used in ex vivo reporter assays of several types. One type is exemplified in the publication of Adler et al. *Cell* 100:693 (2000) (incorporated herein by reference in its entirety). The method employs calcium-sensitive dyes to assay the release of calcium from intracellular stores in response to G protein activation by ligand binding to the expressed T2R receptor protein. Another contemplated method employs direct measurement of G protein activation by binding of a radioactive, nonhydrolyzable analog of GTP in a cell-free reconstituted system containing G proteins, T2R receptor, and ligand, as described by Sainz et al. *Abstracts of the XXVI Meeting of the Association for Chemoreception Sciences,* 211:55, 2004 (incorporated herein by reference). Either of these systems can be used, for instance in an array-based format, to identify or develop ligands that interact with T2R isoforms or sets of isoforms, or with specific T2R genes, as well as to identify agents that influence the binding of such ligands. For instance, agents that reduce (e.g., block) the binding of a ligand to a specific T2R isoform (or set thereof), or that compete with the binding of a known ligand, can be identified by a reduction in signal in a calcium-sensitive dye system, or by the reduction in binding of the radioactive GTP analog. Agents that increase or enhance the binding of a ligand can be identified by increased signals in either system.

VI. Overview of Several Specific Embodiments

Encompassed herein are isolated T2R variant-specific nucleic acid molecules, each of which comprise at least about 10 contiguous nucleotides that span (that is, include) at least one SNP identified as new in FIG. 1. Also provided are arrays, which comprising two or more such nucleic acid molecules. By way of example, such arrays can comprise at least one nucleic acid molecule comprising at least about 10 contiguous nucleotides from T2R1, T2R3, T2R4, T2R5, T2R7, T2R8, T2R9, T2R10, T2R13, T2R14, T2R16, T2R38, T2R39, T2R40, T2R41, T2R43, T2R44, T2R45, T2R46, T2 R47, T2R48, T2R49, T2R50, and T2R60, and spanning at least one SNP identified as new in FIG. 1. Other examples of the array comprise at least one oligonucleotide from each T2R haplotype/allele listed in Table 7. Specific examples of the arrays are in the format of microarrays.

Also provided are collections of two of more isolated T2R variant-specific nucleic acid molecule (in other words, specific for at least one variant position in a T2R gene described herein), each nucleic acid molecule in the collection comprising at least about 10 contiguous nucleotides spanning at least one T2R SNP position listed in Table 7. Examples of such collections comprise at least one isolated T2R variant-specific nucleic acid molecule from T2R1, T2R3, T2R4, T2R5, T2R7, T2R8, T2R9, T2R10, T2R13, T2R14, T2R16, T2R38, T2R39, T2R40, T2R41, T2R43, T2R44, T2 R46, T2R47, T2R48, T2R49, T2R50, and T2R60. Other collections comprise at least one isolated T2R variant-specific nucleic acid molecule from every SNP listed in Table 7. Still other collections comprise at least one isolated T2R variant-specific nucleic acid molecule from each of SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, and 263. For instance, in examples of such collections, the isolated T2R variant-specific nucleic acid molecules have a sequence as shown in SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, or 263.

Optionally, in collections provided herein, each nucleic acid molecule is stored in a separate container. For instance, the separate containers in some embodiments are wells of a microtiter plate or equivalent thereof. In other embodiments, the nucleic acid molecules of the collections are affixed to a solid surface in an array, such as a microarray.

In one embodiment, the microarray collection comprises nucleic acid molecules having the sequence as set for in SEQ ID NO: 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, and 263.

Other specific contemplated collections contain isolated T2R variant-specific nucleic acid molecules taken from a single T2R gene. For instance, collections are contemplated wherein the molecules comprise: (a) SEQ ID NOs: 47, 49, and 51; (b) SEQ ID NOs: 53 and 55; (c) SEQ ID NOs: 57, 59, 61, 63, 65, 67, 69, and 71; (d) SEQ ID NOs: 73, 75, 77, 79, 81, 83, and 85; (e) SEQ ID NOs: 87, 89, 91, 93, and 95; (f) SEQ ID NOs: 97, 99, 101, 103, 105, and 107; (g) SEQ ID NOs: 109, 111, 113, 115, 117, 119, 121, and 123; (h) SEQ ID NOs: 125, 127, 129, and 131; (i) SEQ ID NOs: 133 and 135; (j) SEQ ID NOs: 137, 139, and 141; (k) SEQ ID NOs: 143, 145, 147, 149, and 151; (l) SEQ ID NOs: 153, 155, 157, 159, 161, 163, and 165; (m) SEQ ID NOs: 167 and 169; (n) SEQ ID NOs: 171, 173, 175, and 179; (o) SEQ ID NOs: 181, 183, and 185; (p) SEQ ID NOs: 187, 189, 191, 193, 195, 197, and 199; (q) SEQ ID NOs: 201, 203, 205, 207, 209, and 211; (r) SEQ ID NOs: 213, 215, 217, and 219; (s) SEQ ID NOs: 221, 223, 225, 227, 229, 231, 233, 235, and 237; (t) SEQ ID NOs: 239, 241, 243, 245, 247, 249 and 251; (u) SEQ ID NOs: 253, 255, 257, and 259; (v) SEQ ID NOs: 261 and 263; or (w) a combination of two or more of (a) through (v).

Also provided are isolated T2R polypeptide isoform fragment, such as polypeptide fragments encoded by an isolated T2R variant-specific nucleic acid molecule that comprises at least about 10 contiguous nucleotides that span (that is, include) at least one SNP identified as new in FIG. 1.

Another embodiment is an isolated T2R isoform polypeptide fragment comprising an amino acid sequence comprising at least 10 contiguous amino acids of SEQ ID NO: 2, 4, 6, 8, 10, 12, 14, 16, 18, 20, 22, 24, 26, 28, 30, 32, 34, 36, 38, 40, 42, 44, 50, 56, 58, 60, 64, 66, 68, 70, 72, 76, 78, 80, 82, 84, 86, 90, 92, 94, 96, 100, 102, 104, 106, 108, 112, 114, 116, 118, 120, 122, 124, 126, 128, 130, 136, 140, 142, 148, 150, 152, 156, 158, 162, 164, 170, 174, 176, 178, 180, 182, 184, 188, 190, 192, 198, 200, 202, 204, 206, 210, 212, 214, 218, 220, 226, 228, 230, 232, 234, 236, 238, 242, 244, 246, 248, 250, 252, 254, 258, 260, or 264, which fragment includes at least one amino acid variation as set forth in FIG. 1 or Table 7.

Also provided are isolated T2R polypeptide isoforms, which comprise an amino acid sequence selected from SEQ ID NO: 50, 56, 58, 60, 64, 66, 68, 70, 72, 76, 78, 80, 82, 84, 86, 90, 92, 94, 96, 100, 102, 104, 106, 108, 112, 114, 116, 118, 120, 122, 124, 126, 128, 130, 136, 140, 142, 148, 150, 152, 156, 158, 162, 164, 170, 174, 176, 178, 180, 182, 184, 188, 190, 192, 198, 200, 202, 204, 206, 210, 212, 214, 218, 220, 226, 228, 230, 232, 234, 236, 238, 242, 244, 246, 248, 250, 252, 254, 258, 260, or 264, and isolated nucleic acid molecules encoding such T2R polypeptide isoforms, vectors comprising one of the isolated nucleic acid molecules, and host cells comprising such vectors.

Yet further embodiments are isolated nucleic acid molecules comprising a nucleotide sequence for a T2R allele, wherein the nucleotide sequence is selected from SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, or 263, vectors comprising one of the isolated nucleic acid molecules, and host cells comprising such vectors.

A method of screening compounds useful for modulating bitter taste is also provided. Such methods comprise contacting a test compound with a host cell (such as a eukaryotic cell, for instance a HE 293 cell) or membrane thereof that expresses a T2R taste receptor isoform encoded by an isolated nucleic acid molecule described herein; and detecting a change in the expression of the nucleotide sequence or a change in activity of the T2R taste receptor, or detecting binding of the compound to the T2R taste receptor or detecting a change in the electrical activity of the host cell or a change in intracellular or extracellular cAMP, cGMP, IP3, or $Ca^{2+}$ of the host cell. In certain embodiments, the gene product of said nucleotide sequence is fused to a sequence that facilitates localization to the cell membrane, wherein sequence is at least 20 consecutive N terminal amino acids of a rhodopsin protein. In examples of the screening methods, a change in intracellular $Ca^{2+}$ is detected by measuring a change in a calcium-sensitive dye dependent fluorescence in the cell. In a preferred embodiment, a change in intracellular $Ca^{2+}$ is detected by measuring a change in Fura-2 fluorescence in the cell.

Another example of such a screening method is a high throughput method, which method comprises: contacting in parallel a test compound with a collection of host cells or membranes thereof each of which expresses a different T2R taste receptor isoform encoded by an isolated nucleic acid molecule comprising a nucleotide sequence for a T2R allele, wherein the nucleotide sequence is selected from SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259, and 263; and detecting a change in the expression of at least one of the nucleotide sequences or a change in activity of at least one of the T2R taste receptors, or detecting binding of the compound to at least one of the T2R taste receptors or detecting a change in the electrical activity of at least one of the host cells or a change in intracellular or extracellular cAMP, cGMP, IP3, or $Ca^{2+}$ of at least one of the host cells. Optionally, the collection of host cells or membranes thereof are in the form of an array.

Another provided method is an in vivo method of screening compounds useful for modulating bitter taste, comprising: contacting a test compound to a T2R taste receptor isoform encoded by an isolated T2R nucleic acid molecule described herein; and detecting a change in the activity of the T2R taste receptor, or detecting binding of the compound to the T2R taste receptor. Examples of this method are high throughput methods, and comprise: contacting in parallel a test compound with a collection of different T2R taste receptor isoforms encoded by the isolated nucleic acid molecules; and detecting a change in the activity of at least one of the T2R taste receptors, or detecting binding of the compound to at least one of the T2R taste receptors. Optionally, the collection of different T2R taste receptor isoforms are in the form of an array.

Another embodiment provides a specific binding agent capable of discriminating between or among two or more T2R polypeptide isoforms, or isoform specific fragments thereof. Examples of such specific binding agents are antibodies, such as for instance, monoclonal antibodies.

Yet another provided method is a method of determining a T2R genotype of a subject (e.g., genotyping or haplotyping a subject), comprising: obtaining a test sample of DNA containing a T2R sequence of the subject; and determining whether the subject has a polymorphism in the T2R sequence, wherein the polymorphism is selected from the SNPs referred to as new in FIG. 1.

Also provided is a method of identifying a plurality of individuals who are genetically heterogeneous in at least one T2R gene, comprising: determining a T2R genotype for a plurality of subjects; and selecting group of the subjects who are genetically heterogeneous in at least one T2R gene. Optionally, the plurality of individuals are selected to represent the genetic profile of a geographically defined population, such as for instance the genetic profile of Europeans, East Asians, or Africans.

Also provided herein are kits. A first kit is provided for determining whether or not a subject has a selected T2R genotype or haplotype, comprising: a container comprising at least one oligonucleotide specific for a T2R sequence comprising at least one SNP referred to as new in FIG. 1; and instructions for using the kit, the instructions indicating steps for: performing a method to detect the presence of variant T2R nucleic acid in the sample; and analyzing data generated by the method, wherein the instructions indicate that presence of the variant nucleic acid in the sample indicates that the individual has the selected T2R genotype or haplotype. Optionally, such kits in some embodiments will further comprise a container that comprises a detectable oligonucleotide.

Further, a kit is provided for determining whether or not a subject has a selected T2R genotype or haplotype, the kit comprising a container comprising a T2R isoform-specific antibody; a container comprising a negative control sample; and instructions for using the kit, the instructions indicating steps for: performing a test assay to detect a quantity of T2R isoform protein in a test sample of tissue and/or bodily fluid from the subject, performing a negative control assay to detect a quantity of T2R isoform protein in the negative control sample; and comparing data generated by the test assay and negative control assay, wherein the instructions indicate that a quantity of T2R isoform protein in the test sample more than the quantity of T2R isoform protein in the negative control sample indicates that the subject has the selected T2R genotype of haplotype, and wherein the T2R isoform-specific antibody is specific for a T2R isoform having a sequence selected from SEQ ID NOs: 50, 56, 58, 60, 64, 66, 68, 70, 72, 76, 78, 80, 82, 84, 86, 90, 92, 94, 96, 100, 102, 104, 106, 108, 112, 114, 116, 118, 120, 122, 124, 126, 128, 130, 136, 140, 142, 148, 150, 152, 156, 158, 162, 164, 170, 174, 176, 178, 180, 182, 184, 188, 190, 192, 198, 200, 202, 204, 206, 210, 212, 214, 218, 220, 226, 228, 230, 232, 234, 236, 238, 242, 244, 246, 248, 250, 252, 254, 258, 260, and 264. Optionally, examples of such kits further comprising a container that comprises a detectable antibody that binds to the antibody specific for the T2R isoform protein.

Another provided method is a method of screening for a compound useful in influencing T2R taste perception in a mammal, comprising determining if a test compound binds to or interacts with the T2R polypeptide isoform described herein or an isolated T2R polypeptide isoform fragment specific for a T2R variant, and selecting a compound that so binds. In certain examples of this method, binding of the compound inhibits a T2R protein biological activity. In other examples, the compound stimulates a T2R protein biological activity.

The following examples are provided to illustrate certain particular features and/or embodiments. These examples should not be construed to limit the invention to the particular features or embodiments described. In particular, other methods known to those of ordinary skill in the art can be substituted for specific methods described herein. By way of example, additional methods for studying bitter taste receptors and compounds that interact therewith are described in PCT/US02/23172 (published as WO 03/008627), herein incorporated by reference in its entirety.

EXAMPLES

Example 1

Characterization of SNPs in the T2R (TAS2R) Bitter Taste Receptor Gene PTC

The ability to taste the substance phenylthiocarbamide (PTC) has been widely used for genetic and anthropological studies, but genetic studies have produced conflicting results and demonstrated complex inheritance for this trait. We have identified a small region on chromosome 7q that shows strong linkage disequilibrium between SNP markers and PTC taste sensitivity in unrelated subjects. This region contains a single gene that encodes a member of the TAS2R bitter taste receptor family.

This example describes the identification and analysis of single nucleotide polymorphisms and haplotypes in the PTC gene. We identified three coding SNP's giving rise to five haplotypes in this gene worldwide. These haplotypes completely explain the bimodal distribution of PTC taste sensitivity, thus accounting for the inheritance of the classically defined taste insensitivity, and 55-85% of the variance in PTC sensitivity. Distinct phenotypes were associated with specific haplotypes, demonstrating the direct influence of this gene on PTC taste sensitivity, and that variant sites interact with each other within the encoded gene product.

Methods and Materials:

PTC phenotype determinations. Subjects began tasting a solution of 1 micromolar PTC (solution #14) and proceeded in 2-fold increasing concentration increments (solutions 13, 12, 11 . . . ) until a bitter taste was perceived. Subjects then performed a blinded sorting test containing 3 cups of PTC solution and 3 cups of water. Raw taste threshold was the most dilute solution at which the subject could correctly sort all 6 cups. We also included a quinine threshold measurement according to Blakeslee & Salmon (*Proc. Natl. Acad. Sci. USA* 21, 84, 1935) to identify and exclude individuals with general deficits in bitter taste (aguesia). For dichotomous assignment of phenotype, we considered individuals unable to taste PTC before solution #6, i.e. at concentrations less than 267 micromolar PTC, to be non-tasters. Although the classic method includes corrections for age and sex, analysis of our raw PTC taste threshold data indicated only a modest sex effect, with females more sensitive than males (p=0.00324, proportion of variance explained=5.1%). No effect of age on PTC scores was observed. As a result, raw PTC threshold scores were used for all analyses.

Research subjects. The Utah C.E.P.H. families were enrolled in conjunction with the Utah Genetic Reference Project under University of Utah IRB approved protocol #6090-96, and consisted of individuals of Northern European ancestry. Subjects in the NIH replication sample were enrolled under NIH/NINDS IRB approved protocol # DC-01-230, and were of European, Asian, African American, and Native American ancestry. Human Diversity Panel DNAs (sub-Saharan African, Asian, and Southwest Native American) and primate DNAs were obtained from the Coriell Cell Repository, Camden, N.J. The Utah sample consists of 27 families comprising 269 individuals; both haplotype and phenotype information was available for 180 of these individuals. The NIH replication sample of consisted of 85 unrelated individuals of known haplotype and phenotype; 51 were European, 5 Pakistani, 23 East Asian, and 6 African-American. One African-American is not considered in the analysis due to a rare AAV/AAI diplotype. His raw PTC score is 7.

Bioinformatics analyses. Bioinformatics analysis was performed with the NCBI Human Genome databases (available on the Web at ncbi.nlm.nih.gov/genome/guide/human) and the Celera Discovery System (available online at cds.celera.com/cds). Gene finding was performed with BLASTX (available on the Web at ncbi.nlm.nih.gov/BLAST) and GENESCAN and FGENES software (GeneMachine, DIR, NIH, available online at genome.nhgri.nih.gov/genemachine/). SNPs were developed using the SNP database (available on the Web at ncbi.nlm.nih.gov/SNP/).

PTC gene haplotyping. Haplotypes within the PTC gene were determined by performing genomic PCR to obtain a 1195 bp product containing all 3 variant sites, using primers as follows: F=5'GCTTTGTGAGGAATCAGAGTTGT 3', R=5' GAACGTACATTTACCTTTCTGCACT 3'. The mass PCR product from each individual was cloned into TopoTA vector (Clonetech), and single colonies which contained a single amplified haplotype were picked and sequenced.

QTL linkage analysis. Quantitative trait linkage analysis was performed using SOLAR, Almassy and Blangero, *Am. J. Hum. Genet.* 62, 1198, 1998. The effect of PTC haplotypes on the linkage results was determined by performing two multipoint linkage analyses: one using the raw PTC scores and another using adjusted PTC scores, both with sex as a covariate. The first analysis excluded diplotypes as covariates, the second included them. For the latter, adjusted scores were obtained by subtracting off the mean of each diplotype group from the scores of individuals with that particular diplotype.

Haplotype effect analysis. The effect of the PTC haplotypes, as well as the covariates sex and age, on raw PTC scores was estimated simultaneously in a multivariate analysis using the program SOLAR[26]. SOLAR estimates the proportion of variance explained by a covariate (e.g., the PTC diplotype) in the presence of background polygenic variance, in this case estimated from residual familial correlation in the phenotype. The program also takes into account non-independence of sib genotypes. The confirmation sample of unrelated individuals was analyzed using multiple linear regression with sex and age as covariates as well as Analysis of Variance.

GenBank. Human candidate taste receptor gene TAS2R38 (GenBank accession number AF494231) is identical to the sequence of the non-taster AVI form of the PTC gene, with the exception of nucleotide 557, which is an A (encoding $Asn^{186}$) in TAS2R38 and a T (encoding $Ile^{186}$) in PTC.

Material in this example was published as Kim et al., Science 299:1221-1225, Feb. 21, 2003, which publication is incorporated herein by reference in its entirety, including the supplemental material published on-line at scienemag.org/cgi/content/full/299/5610/121/DC1.

Results and Discussion

The inability to taste PTC (*Science* 73:4, 1931; Guo and Reed, *Ann. Hum. Biol.* 28:111, 2001) was long believed to be a simple Mendelian recessive trait (Snyder, *Science* 74:151, 1931; Levit and Soboleva, *J. Genetics* 30:389, 1935; Blakeslee, *Proc. Acad. Natl. Acad. Sci. USA* 18:120, 1932; Lee, Ohio *J. Science* 34:337, 1934; Harris and Kalmus, *Ann. Eugenics, London* 15:24, 1949). Over time however, many reports emerged which contradicted this model (Falconer, *Ann. Eugenics* 13:211, 1946-47; Reddy and Rao, *Genet. Epidemiol.* 6:413, 1989; Olson et al., *Genet. Epidemiol.* 6:423, 1989). Linkage studies have been equally conflicting. Initial studies provided very strong support for linkage to the KEL blood group antigen (later determined to reside on chromosome 7q3) (Chautard-Freire-Maia et al., *Ann. Hum. Genet.* 38:191, 1974; Conneally et al., *Hum. Hered.* 26:267, 1976), but other studies failed to provide significant support for this linkage (Spence et al., *Hum. Genet.* 67:183, 1984). The only genome-wide linkage survey was performed with the related compound propyl-thiouracil. This study produced evidence for linkage to loci on chromosome 5p, and a suggestion of linkage to markers on chromosome 7q31, at a distance of ~35 cM from KEL (Reed et al., *Am. J. Hum. Genet.* 64:1478, 1999).

We performed a genome-wide linkage analysis with the Utah C.E.P.H. families (Dausset et al., *Genomics* 6:575, 1990; NIH/CEPH Collaborative Mapping Group, *Science* 258:67, 1992; Materials and methods are available as supporting material on Science Online.) using a blind sorting test to measure individual's PTC sensitivity thresholds (Materials and methods are available as supporting material on *Science* Online; Harris and Kalmus, *Ann. Eugenics, London* 15:24, 1949; Kalmus, *Ann. Hum. Genet.* 22:222, 1958), and demonstrated strong support for a major locus on chromosome 7q, close to KEL (Prodi et al., *Am. J. Hum. Genet.* Suppl. 71(4): 464, 2002; Drayna et al., *Hum. Genet.* 112:567, 2003) with a critical region spanning approximately 4 Mb in the region of D7S661, with a maximum lod score of 8.85 (Drayna et al., *Hum. Genet.* 112:567, 2003).

Bioinformatic analyses (Materials and methods are available as supporting material on *Science* Online.) indicated the ~4 Mb region on chromosome 7q contains over 150 genes, including the KEL blood group antigen, confirming previous linkage studies (Chautard-Freire-Maia et al., *Ann. Hum. Genet.* 38:191, 1974; 13. Conneally et al., *Hum. Hered.* 26:267, 1976). In addition, this region contains a number of TAS2R bitter taste receptor genes (Adler et al., *Cell* 100:693, 2000) and odorant receptor-like genes (Buck and Axel, *Cell* 65:175, 1991). All TAS2R's (9 genes) and OR-like genes (7 genes) were evaluated as candidates by sequencing the entire single coding exon, the 3' UTR, and 300 bp upstream in individuals within families showing linkage to chromosome 7q, and numerous sequence variants were observed (Ewing et al., *Genome Res.* 8:175, 1998; 26. Gordon et al., *Genome Res.* 8:195, 1998. Seqman (DNA STAR, Madison, Wis.)). One of these variants demonstrated strong association with taste phenotype across different C.E.P.H. families (chi-square $p<10^{-10}$), suggesting it may be the functional change or close to the functional change(s). To more fully understand linkage and LD relationships in this region, we performed further analysis by means of 50 SNPs at an average spacing of 50 kb across this interval. These SNPs revealed crossover breakpoints in the Utah C.E.P.H. families that reduced the minimal region to 2.6 Mb.

Using these 50 SNP's, strong LD was observed between taster status and markers in only one portion of this 2.6 Mb interval. This was observed initially in the chromosome 7-linked families (12 families containing 107 individuals) and subsequently in unrelated non-tasters from both the C.E.P.H. sample (an additional 8 individuals) and in a second replication population (the NIH sample, 15 non-taster and 14 taster Caucasians, 7 non-taster and 9 taster East Asians). Significant LD was observed across a 150 kb region, extending from approximately 139,835,000 to 139,981,000 bp on the chromosome 7 genomic sequence (available on the Web at ncbi.nlm.nih.gov/genome/guide/human). In the NIH sample of 45 individuals, analysis of chi-square (equivalent to $r^2$) and delta statistics showed clear peak values for each measure within the BAC RP11-707F14 (AC073647.9) ($p<10^{-10}$), at the identical location in the Caucasian and East Asian subgroups as well as for the Mantel-Haenszel combined chi-square. In a group of 37 unrelated non-taster individuals (12 Utah individuals and 25 individuals from the NIH sample who collectively had the poorest PTC sensitivities), the physical distance over which these individuals carried unambiguous haplotypes sharing the same SNP alleles extended an average of 61 kb, with the minimal shared region extending from 42,445 bp to 72,141 bp in this BAC, a distance of 29,696 bp. Bioinformatic and gene prediction analyses revealed that the only gene in this 29.7 kb interval was the TAS2R bitter receptor gene in which we originally identified strong LD.

This gene, which we have designated PTC, consists of 1002 bp in a single exon, encoding a 7 transmembrane domain, G-protein-coupled receptor that shows 30% amino acid identity with human TAS2R7, the most closely related member of this family. Within this gene, we identified 3 common SNPs, all of which result in amino acid changes in the protein (Table 1). The A49P variant demonstrated a strong association overall with taster status in the Utah sample (Table 2), and an even stronger association in the NIH replication sample (Table 2). The association of taster status with the val262 allele was similarly strong in both the Utah and NIH samples (Table 2). To better understand the effect of these SNP's, we investigated the haplotypes in this gene.

TABLE 1

Polymorphisms within the PTC gene

| Position (bp. | a.a.) | Allele | Frequency | AA encoded |
|---|---|---|---|---|
| 145 | 49 | C | .48 | Pro |
|  |  | G | .51 | Ala |
| 785 | 262 | C | .38 | Ala |
|  |  | T | .62 | Val |
| 886 | 296 | G | .38 | Val |
|  |  | A | .62 | Ile |

TABLE 2

The effect of homozygosity for SNPs on phenotype

| Homozygous | | No. of subjects (total no.) | | | |
|---|---|---|---|---|---|
| SNP | Sample | Non-tasters | Tasters | $\chi^2$ | P value |
| Ala 49 | Utah | 48 (51) | 21 (129) | 27.23 | $1.81 \times 10^{-7}$ |
|  | NIH | 22 (23) | 3 (61) | 72.74 | $1.61 \times 10^{-16}$ |
| Val 262 | Utah | 38 (51) | 14 (129) | 23.40 | $1.10 \times 10^{-6}$ |
|  | NIH | 21 (23) | 0 (61) | 74.44 | $6.83 \times 10^{-17}$ |

\* The third SNP, I296V, was in complete linkage disequilibrium with V262A (and thus gave identical results to V262A) except in one African-American subject.

Haplotype analysis in the Utah and NIH samples revealed two predominant haplotypes at the three SNPs in this gene. Named in the order of the three SNPs (A49P, V262A, and I296V), the non-taster haplotype AVI and taster haplotype PAV accounted for 47% and 49% of all haplotypes respectively in the European sample, and 30% and 70% respectively in the East Asian sample. Europeans also possessed the presumed recombinant taster haplotype AAV at a frequency of 3%. The haplotype association with taster status was more definitive than for individual SNP's; the strongest association with non-taster status is for the AVI homozygote, followed by the compound heterozygote AVI/AAV (Table 3).

TABLE 3

Haplotype association with taste phenotypes

| | | No. of subjects | |
|---|---|---|---|
| Haplotypes | Sample | Non-tasters | Tasters |
| AVI/AVI | Utah | 38 | 14 |
|  | NIH | 21 | 0 |
| AVI/AAV | Utah | 10 | 7 |
|  | NIH | 1 | 3 |
| \*/PAV | Utah | 3 | 108 |
|  | NIH | 1 | 58 |

\* indicates any haplotype found in the sample. No AAV homozygotes were observed in either sample.

Due to the broad and continuous distribution of PTC sensitivity in the population, we went on to analyze PTC scores as a quantitative trait. There was a consistent and significant difference in PTC scores between diplotypes in both the Utah and the NIH samples, consistent across racial groups. PAV homozygotes had the highest mean PTC scores (Utah: 10.69, NIH: 10.00), PAV heterozygotes had slightly but significantly lower mean PTC scores (Utah: 9.65, NIH: 8.81) than the PAV homozygotes (Utah sample: $\chi^2=8.41$, p=0.0037, NIH replication sample: t=3.29, p=0.0017). AVI homozygotes had the lowest mean PTC scores (Utah: 4.31, NIH: 1.86). Thus the taster PAV form of the gene displays a heterozygote effect, with two copies conferring greater PTC sensitivity than a single copy. The difference in mean PTC score between the rare AAV/AVI heterozygotes and the AVI homozygotes was significant in the NIH sample (t=5.44, p=5.41×10$^{-5}$) and tended toward significance in the Utah family sample ($\chi^2=2.39$, p=0.122). PAV/AAV heterozygotes were not significantly different from PAV/AVI heterozygotes ($\chi^2=0.58$, p=0.45).

Differences in PTC score by diplotype in the Utah families were also highly significant in a multivariate analysis ($\chi^2=148.95$, p<10$^{-33}$). Sex and the haplotype effect explain 59.7% of the total variance in PTC scores. Analysis of variance of the NIH sample confirmed these results (F=152.73, p<10$^{-32}$), with 84.8% of the variance explained by the haplotype effect. The differences were also significant in both the Caucasian subgroup of the replication sample (F=78.60, p<10$^{-18}$) and the East Asian subgroup (F=139.02, p<10$^{-11}$).

The bimodal distribution of PTC scores is a combination of the underlying distributions of the PTC diplotypes, i.e. genotypes at multiple variable sites with consideration of haplotype. The appearance of bimodality is driven by the distribution of the common AVI homozygote, PAV/AVI heterozygote and PAV homozygote diplotypes. The mode of inheritance of PTC taste sensitivity has been a subject of controversy (Guo and Reed, *Ann. Hum. Biol.* 28:111, 2001; Reddy and Rao, *Genet. Epidemiol.* 6:413, 1989; Olson et al., *Genet. Epidemiol.* 6:423, 1989). To determine whether there was evidence for additional genetic contributions to PTC score, we examined the heritability in subsets of the Utah sample. In the subgroups which were large enough to give accurate estimates, heritability was 0.26±0.19 (83 subjects in 20 families) in the PAV/AVI subgroup, and 0.50±0.33 in the AVI/AVI subgroup (46 subjects in 17 families). The increase in heritability in the loss of function diplotype group (AVI/AVI) indicates that there may be other genetic factors that interact with PTC and can restore some measure of taste sensitivity in this group. For Caucasians and East Asians, our results are largely consistent with a model of a major recessive QTL modified either by a polygenic (Reddy and Rao, *Genet. Epidemiol.* 6:413, 1989) or single locus (Olson et al., *Genet. Epidemiol.* 6:423, 1989) residual background effect.

Due to the high frequency of the PAV and AVI haplotypes in the population, we sought to determine which haplotype represents the original form of the PTC gene. We sequenced this gene in 6 primate species: humans and one individual each from chimpanzee, lowland gorilla, orangutan, crab-eating macaque (an old world monkey), and black-handed spider monkey (a new world monkey), representing over 25 million years of evolutionary divergence. All of the non-human primates were homozygous for the PAV form, indicating that the AVI form arose in humans after the time they diverged from the nearest common primate ancestors.

Five different haplotypes were observed worldwide (Table 4). In Europeans and Asians, the taster haplotype PAV and the non-taster haplotype AVI make up the vast majority of haplotypes present. Two additional haplotypes, PVI and AAI, were observed only in individuals of sub-Saharan African ancestry, consistent with other reports of increased gene haplotype diversity in this population (Stephens et al., *Science* 293:489, 2001). The common non-taster AVI haplotype was observed in all populations except Southwest Native Americans, who were exclusively homozygous for the PAV haplotype, consistent with the reported low frequency of non-tasters in this population (Guo and Reed, *Ann. Hum. Biol.* 28:111, 2001). Thus overall, the worldwide distribution of these haplotypes is consistent with the large anthropologic literature on the distribution of this phenotype (Boyd, "Genetics & the Races of Man. An introduction to modern physical anthropology." Little Brown and Company, Boston, 1950; Tills et al., "The Distribution of Human Blood Groups and other Polymorphisms," Supplement, 1$^{st}$ Edition. Oxford University Press, Oxford, 1983).

TABLE 4

Frequency of PTC Gene Haplotypes in Populations Worldwide

| Haplotype | European (n = 200) | West Asian (n = 22) | East Asian (n = 54) | African (n = 24) | S.W. Native American (n = 18) |
|---|---|---|---|---|---|
| AVI | 0.47 | 0.67 | 0.31 | 0.25 | |
| AAV | 0.03 | | | 0.04 | |
| AAI | | | | 0.17 | |
| PAV | 0.49 | 0.33 | 0.69 | 0.50 | 1.00 |
| PVI | | | | 0.04 | |

The amino acid substitutions in the PTC protein may affect the function of this protein in several ways. Position 49 resides in the predicted first intracellular loop, and this SNP represents a major amino acid alteration, proline in tasters to alanine in non-tasters. The SNP's at positions 262, in the predicted 6$^{th}$ transmembrane domain, and position 296, in the predicted 7$^{th}$ transmembrane domain specify relatively conserved amino acid changes, alanine to valine and valine to isoleucine, respectively. Based on phenotype data, we hypothesize that the substitutions at positions 49 and 262 significantly alter the biochemical function of this protein, while the substitution at position 296 modifies the function more subtly. These alterations could affect coupling to its cognate G proteins on the intracellular side of the plasma membrane, as has been observed for other variants in the first intracellular loop (Nabhan et al., *Biochem. Biophys. Res. Comm.* 212:1015, 1995; O'Dowd et al., *J. Biol. Chem.* 263: 15985, 1988), or in other portions of these proteins (G protein receptor database: available on the Web at gpcr.org, grap.f-agmed.uit.no). Given that PTC and other compounds which contain the N—C=S moiety are both bitter and toxic in large doses, it will be of interest to determine how the non-taster allele rose to such high frequency, especially in the European population.

Substantial variation in taste sensitivity exists in humans (Blakeslee and Salmon, *Proc. Natl. Acad. Sci. USA* 21:84, 1935), and given the great degree of sequence diversity and variation in bitter taste receptor genes (Ueda et al., *Biochem. Biophys. Res. Comm.* 285:147, 2001), we hypothesize much of this phenotypic variation is genetic in origin. Understanding the nature of this variation, especially variation in bitter taste, and its relationship to diet and other behaviors such as smoking may have important implications for human health (Tepper, *Am. J. Hum. Genet.* 63:1271, 1998; Enoch et al., *Addictive Behav.* 26:399, 2001).

Example 2

Natural Selection and Molecular Evolution in PTC

This example describes an investigation of selective effects on the phenylthiocarbamide (PTC) gene by use of analyses of molecular genetic data. By examining patterns of DNA sequence variation, we were able to test the PTC gene for evidence of long-term selective pressures. As predicted by Fisher >60 years ago (Fisher et al., *Nature* 144:7-50, 1939), we found support for the hypothesis that balancing natural selection has acted to maintain taster and nontaster alleles in human populations. This investigation has also been reported in Wooding et al. (*J. Hum. Genet.* 74:637-646, 2004), which is incorporated herein by reference in its entirety.

The ability to taste PTC is a classic phenotype that has long been known to vary in human populations. This phenotype is of genetic, epidemiologic, and evolutionary interest because the ability to taste PTC is correlated with the ability to taste other bitter substances, many of which are toxic. Thus, variation in PTC perception may reflect variation in dietary preferences throughout human history and could correlate with susceptibility to diet-related diseases in modern populations.

To test R. A. Fisher's long-standing hypothesis that variability in PTC perception has been maintained by balancing natural selection, we examined patterns of DNA sequence variation in the recently identified PTC gene, which accounts for up to 85% of phenotypic variance in the trait. We analyzed the entire coding region of PTC (1,002 bp) in a sample of 330 chromosomes collected from African (n=62), Asian (n=138), European (n=110), and North American (n=20) populations by use of new statistical tests for natural selection that take into account the potentially confounding effects of human population growth. Two intermediate-frequency haplotypes corresponding to "taster" and "nontaster" phenotypes were found. These haplotypes had similar frequencies across Africa, Asia, and Europe. Genetic differentiation between the continental population samples was low ($F_{ST}=0.056$) in comparison with estimates based on other genes. In addition, Tajima's D and Fu and Li's D and F statistics demonstrated a significant deviation from neutrality because of an excess of intermediate-frequency variants when human population growth was taken into account (P<0.01). These results combine to suggest that balancing natural selection has acted to maintain "taster" and "nontaster" alleles at the PTC locus in humans.

Methods

DNA sequences from the entire coding region of PTC (1,002 bp, 333 amino acids) were obtained by use of methods described above and in the work of Kim et al. (*Science* 299: 1221-1225, 2003) and Drayna et al. (*Hum Genet* 112:567-572, 2003) (both of which are incorporated herein by reference in their entireties), from 165 individuals of the following descents: African (9 sub-Saharan Africans from Coriell Human Variation panel HD12, 22 Cameroonians), Asian (17 Chinese, 13 Japanese, 12 Koreans, 7 Middle Easterners, 10 Pakistanis, 10 other Southeast Asians), European (10 Hungarians, 45 Utah samples from Centre d'Etude du Polymorphisme Human), and North American (10 Southwest Native Americans). For comparison, sequences were also obtained from one chimpanzee (*Pan troglodytes*) and one gorilla (*Gorilla gorilla*).

Ambiguous haplotypes were resolved using molecular techniques. In such individuals, the two allelic versions of the gene were cloned as single PCR products and individual clones were sequenced to reveal both haplotypes. Phylogenetic relationships among haplotypes were inferred using the neighbor-joining algorithm of the PHYLIP software package (Felsenstein 1993). This tree, which was rooted using the gorilla sequence, was then used to determine the polarity of character states. Evolutionary relationships among haplotypes were visualized using a minimum spanning tree generated by the ARLEQUIN computer program (Schneider et al., "ARLEQUIN version 2.000: a software for population genetics data analysis. Genetics and Biometry Laboratory, Department of Anthropology, University of Geneva, Geneva, Switzerland 2000).

Tajima's D (Tajima, *Genetics* 123:585-595, 1989) and Fu and Li's D and F statistics (Fu and Li, *Genetics* 133:693-709, 1993) were used to test the hypothesis that patterns of diversity in humans are consistent with the hypothesis of neutrality. To avoid confusion, we refer to Tajima's D as "DT" and Fu and Li's D as "DF." These tests were performed by simulating 10,000 gene genealogies and comparing statistics obtained from the simulations with the observed statistic, as described by Tajima (*Genetics* 123:585-595, 1989) and Fu and Li (*Genetics* 133:693-709, 1993). To incorporate varying assumptions about population size change in human populations, these simulations were performed using the algorithm of Rogers (*Evolution* 49:608-615, 1995). This algorithm assumes that human population sizes increased suddenly from an ancient population size (N0) to a larger population size (N1), t generations ago, with infinite-sites mutation rate. Patterns of genetic diversity produced under these conditions approximate those produced under more complicated conditions, such as exponential and logistic growth (Wooding & Rogers, *Genetics* 161:1641-1650, 2002).

Tests for excesses of synonymous and nonsynonymous nucleotide substitutions were performed using the methods of McDonald and Kreitman (*Nature* 351:652-654, 1991) and Li et al. (*Mol Biol Evol* 2:150-174, 1985). The McDonald-Kreitman test (McDonald & Kreitman, *Nature* 351:652-654, 1991) uses a Fisher's exact test to determine whether the ratio of synonymous and nonsynonymous substitutions differs between two categories: polymorphisms that are variable within species and polymorphisms that distinguish species (i.e., fixed differences). We used the McDonald-Kreitman test to examine polymorphisms found in humans and chimpanzees. The KA/KS test determines whether there is an overall excess of synonymous or nonsynonymous nucleotide substitutions (Li et al., *Mol Biol Evol* 2:150-174, 1985).

Tests for genetic differentiation between populations were performed using Slatkin's linearized FST statistic (Slatkin, *Genet Res* 58:167-175, 1991). The statistical significance of these values was assessed using the bootstrap method of Excoffier et al. (Excoffier et al., *Genetics* 131:479-491, 1992), in which observed values are compared with FST values simulated by randomly allocating chromosomes to different populations. These tests used 10,000 bootstrap replications.

Results and Discussion

DNA sequencing revealed five variable nucleotides in humans, as detailed in Example 1. These variants were partitioned into seven haplotypes. The chimpanzee and gorilla were both homozygous at all nucleotide positions and thus carried one haplotype each. Human and chimpanzee sequences differed by an average of 8.3 nucleotides, as did human and gorilla sequences. The chimpanzee and gorilla sequences differed by six nucleotides. In Table 5A, each haplotype is summarized in two rows. The top row summarizes nucleotide variation in the haplotype, and the bottom row summarizes amino acid variation in the haplotype. Each column represents a codon containing a variable nucleotide position, which is indicated at the top of the column. Shaded columns indicate the three variable amino acid positions used for haplotype designation in Example 1 and Kim et al. (*Science* 299:1221-1225, 2003). The number of occurrences of each haplotype is indicated in Table 5B, for the African (Af), Asian (As), European (Eu), and North American (NA)

samples. Haplotype counts are not given for the chimpanzee and gorilla haplotypes (ptA and ggA, respectively), which were each observed twice.

TABLE 5A

Variable Nucleotide Positions in PTC Haplotypes.

| Haplo-type | 2 3 | 1 4 5 | 2 3 9 | 5 7 0 | 6 9 2 | 6 9 7 | 7 3 2 | 7 8 5 | 8 2 0 | 8 2 2 | 8 8 6 | 99 22 67 | 9 9 5 | SEQ ID NO (NA/AA)[1]: |
|---|---|---|---|---|---|---|---|---|---|---|---|---|---|---|
| hsA | CGC -R- | CCA -P- | CAC -H- | AAT -N- | ACC -T- | AAC -N- | AAA -K- | GCT -A- | CGC -R- | GTC -V- | ATG -M- | CTG -L- | | 153/154 |
| hsB | CGC -R- | CCA -P- | CAC -H- | AAT -N- | ACC -T- | AAC -N- | AAA -K- | GTT -V- | CGC -R- | ATC -I- | ATG -M- | CTG -L- | | 155/156 |
| hsC | CGC -R- | GCA -A- | CGC -H- | AAT -N- | ACC -T- | AAC -N- | AAA -K- | GCT -A- | CGC -R- | ATC -I- | ATG -M- | CTG -L- | | 157/158 |
| hsD | CGC -R- | GCA -A- | CAC -H- | AAT -N- | ACC -T- | AAC -N- | AAA -K- | GCT -A- | CGC -R- | ATC -I- | ATG -M- | CTG -L- | | 159/160 |
| hsE | CGC -R- | GCA -A- | CAC -H- | AAT -N- | ACC -T- | AAC -N- | AAA -K- | GCT -A- | CGC -R- | GTC -V- | ATG -M- | CTG -L- | | 161/162 |
| hsF | CGC -R- | GCA -A- | CAC -H- | AAT -N- | ACC -T- | AAC -N- | AAA -K- | GCT -A- | TGC -C- | ATC -I- | ATG -M- | CTG -L- | | 163/164 |
| hsG | CGC -R- | GCA -A- | CAC -H- | AAT -N- | ACC -T- | AAC -N- | AAA -K- | GTT -V- | CGC -R- | ATC -I- | ATG -M- | CTG -L- | | 165/166 |
| ptA | CAC -H- | CCA -P- | CAC -H- | AAC -N- | ACC -T- | GAC -D- | AAG -K- | GCT -A- | CGT -R- | GTC -V- | ACG -T- | CTG -L- | | N/A |
| ggA | CGC -R- | CCA -P- | CAC -H- | AAC -N- | ATC -I- | GAC -D- | AAA -K- | GCT -A- | CGC -R- | GTC -V- | ACA -T- | CCG -P- | | N/A |

[1]SEQ ID NO: (NA/AA) - Sequence ID number for Nucleic Acid/Amino Acid.

TABLE 5B

Occurrences of Variable Nucleotides in Human PTC Haplotypes.

| | | Af | As | Eu | NA | Total |
|---|---|---|---|---|---|---|
| Haplotype | hsA | 38 | 76 | 51 | 19 | 184 |
| | hsB | 1 | 0 | 0 | 0 | 1 |
| | hsC | 1 | 0 | 0 | 0 | 1 |
| | hsD | 9 | 1 | 0 | 0 | 10 |
| | hsE | 2 | 0 | 5 | 0 | 7 |
| | hsF | 1 | 0 | 0 | 0 | 1 |
| | hsG | 10 | 61 | 54 | 1 | 126 |
| | | 62 | 138 | 110 | 20 | 330 Total |

All five nucleotide substitutions observed in humans caused amino acid substitutions, as did three of the six substitutions distinguishing human and chimpanzee. The observed rate of nonsynonymous substitution was substantially higher than is usually observed in human genes, suggesting that positive natural selection may have acted to preserve new nonsynonymous variants (Makalowski & Boguski, Proc Natl Acad Sci USA 95:9407-9412, 1998; Yang et al., Trends Ecol Evol 15:496-503, 2000; Nekrushenko et al., Genome Res 12:198-202, 2001; Bamshad and Wooding, Nat Rev Genet 4:99-111, 2003). To test the hypothesis that an excess of nonsynonymous substitutions was present, we first analyzed the human and chimpanzee sequences by use of a McDonald-Kreitman test (Nature 351:652-654, 1991), as described in the "Methods" section. This test showed that the excess of nonsynonymous substitutions observed in humans was not statistically significant (P>0.10). A KA/KS test showed that the overall ratio of synonymous to nonsynonymous substitutions did not differ significantly from expectation under neutrality (P>0.10). These nonsignificant results may be attributable to the low number of polymorphisms observed, which weakens the tests. Thus, although notable for being higher than in most genes, the bias toward nonsynonymous variants in our sample was not sufficient to reject the hypothesis of neutrality.

The minimum spanning tree revealed that the human sample was dominated by two major haplotypes, hsA and hsG, differing by three amino acid substitutions. These two haplotypes, which account for >90% of sampled chromosomes, are strongly associated with taster (hsA) and nontaster (hsG) status, respectively (Drayna et al., Hum Genet 112:567-572, 2003; Kim et al., Science 299:1221-1225, 2003). In addition, the hsA and hsG haplotypes were both found at intermediate frequencies: 0.55 and 0.38. A variety of factors, including population subdivision and balancing natural selection, can lead to the presence of two or more intermediate-frequency haplotypes in gene genealogies (Marjoram & Donnelly, Genetics 136:673-683, 1994; Bamshad and Wooding, Nat Rev Genet 4:99-111, 2003). The evolution of two or more intermediate-frequency clusters is also surprisingly common under selectively neutral conditions (Slatkin & Hudson, Genetics 129:555-562, 1991).

To test whether patterns of DNA sequence variation in PTC fit expectations under the hypothesis of evolutionary neutrality, we analyzed the sequences by use of the DT, DF, and F statistics. These statistics are functions of the number of variable nucleotide positions in a sample of sequences, the mean pairwise difference between sequences, and the number of derived variants that are only observed once in the sample, all of which are affected by natural selection (Tajima, Genetics 123:585-595, 1989; Fu and Li, Genetics 133:693-709, 1993). For example, positive natural selection leading to the rapid fixation of a single, advantageous haplotype will result in a decrease in the expected number of polymorphic sites, a decrease in the mean pairwise difference between sequences, and an increase in the number of variants observed only once in the sample (Fu and Li, *Genetics* 133:693-709, 1993). In contrast, balancing natural selection can lead to an increase in all three of these values (Fu and Li, *Genetics* 133:693-709, 1993).

Tests of these statistics performed under the standard assumption of constant population size failed to reject the hypothesis of neutrality in PTC (DT=1.55, P>0.05; DF=– 1.46, P>0.90; F=–0.50, P>0.60). However, several lines of evidence based on archaeology, genetics, and linguistics suggest that human populations have grown dramatically (>100-fold) over the past 100,000 years (Ruhlen, "*The origin of language.*" *John Wiley and Sons, New York* 1994; Klein, "The human career: human biological and cultural origins." University of Chicago Press, Chicago 1999; Stiner et al., *Science* 283:190-194, 1999; Excoffier. *Curr Opin Genet Dev* 12:675-682, 2002). Such growth is known to have strong effects on genetic diversity (Rogers & Harpending, *Mol Biol Evol* 9:552-569, 1992). For example, diversity patterns in populations that have grown are often characterized by an excess of low-frequency genetic variants and a low mean pairwise difference between sequences, both of which lead to reductions in the expected values of all three of the statistic we tested (Wooding & Rogers, *Genetics* 161:1641-1650, 2002). Given evidence for population increase in the Upper Pleistocene and the possible effects of this growth on patterns of genetic diversity, the assumption of constant population size is likely inappropriate.

To investigate the possibility that incorrect assumptions about population history were causing a type II statistical error (i.e., a failure to reject the null hypothesis of neutrality when it is false) in our initial tests, we devised new tests of the DT, DF, and F statistics that take population growth into account. These tests were performed as described in the "Methods" section, under the assumption that human populations increased suddenly from an ancient effective population size of 10,000 to a larger effective population size, N1, t years before present, with a nucleotide-substitution rate of 10-9/site/year. These values are representative of those inferred for nuclear genes in humans (Tishkoff & Verrelli, *Annu Rev Genomics Hum Genet* 4:293-340, 2003). Because there is some disagreement about the timing and magnitude of this expansion (Hey, *Mol Biol Evol* 14:166-172, 1997; Fay and Wu, *Mol Biol Evol* 16:1003-1005, 1999; Harris and Hey, *Evol Anthropol* 8:81-86, 1999; Hey and Harris, *Mol Biol Evol* 16:1423-1426, 1999; Harpending and Rogers, *Annu Rev Genomics Hum Gen* 1:361-385, 2000; Wall & Przeworski, *Genetics* 155:1865-1874, 2000; Excoffier. *Curr Opin Genet Dev* 12:675-682, 2002; Ptak & Przeworski, *Trends Genet* 18:559-563, 2002), we iteratively tested the DT, DF, and F statistics for population histories with magnitudes of population growth from 1-fold to 1,000-fold and dates of population expansion from 0 to 200,000 years ago.

This procedure revealed that tests of all three statistics are highly sensitive to assumptions about population growth. For example, the assumption of 100-fold growth 100,000 years ago resulted in a change of DT's P value from 0.07 to 0.01. CIs generated for the DT statistic showed that the hypothesis of neutrality was rejected (at a two-tailed P value cutoff of 0.025) under all population histories in which the human population expanded between 15-fold and 1,000-fold between 10,000 and 200,000 years ago. In addition, under the population history parameters for which observed DT values differed significantly from expectation, the values were greater than expected. Thus, our data departed from expectation in a direction consistent with the hypothesis of balancing natural selection (Tajima, *Genetics* 123:585-595, 1989; Fu and Li, *Genetics* 133:693-709, 1993). Results were similar for CIs generated using the DF and F statistics, which rejected the hypothesis of neutrality for all population histories in which the human population expanded between 15-fold and 1,000-fold between 30,000 and 200,000 years ago. Thus, the hypothesis of neutrality in PTC was rejected by these tests under all but the most conservative assumptions about population growth in humans.

The sensitivity of the DT, DF, and F statistics to population growth has implications beyond the detection of natural selection in PTC. All three of these statistics are widely used in tests for natural selection in humans, usually under the assumption that human population sizes have remained constant (Tishkoff & Verrelli, *Annu Rev Genomics Hum Genet* 4:293-340, 2003). As we have shown, this assumption is highly conservative in the detection of balancing natural selection. However, the assumption of constant population size is anticonservative in the detection of positive natural selection, which leads to reductions in diversity nearly identical to those caused by population growth (Tajima, *Genetics* 123:585-595, 1989; Fu and Li, *Genetics* 133:693-709,). For this reason, tests for positive natural selection that use the DT, DF, and F statistics are vulnerable to type I statistical errors (i.e., the rejection of the null hypothesis when it is true) if human population increases are not taken into account. With this in mind, the significance of many earlier tests of the DT, DF, and F statistics in humans, including our own (e.g., Wooding & Rogers, *Hum Biol* 72:693-695, 2000; Wooding et al., *Am J Hum Genet* 71:528-542, 2002, may need to be reconsidered.

Balancing selection is not the only force that can lead to significantly high DT, DF, and F values. Such patterns can also be caused by population subdivision, which allows the persistence of divergent haplotypes in different geographical regions (Kaplan et al., *Genet Res* 57:83-91, 1991; Hudson et al., *Mol Biol Evol* 9:138-151, 1992; Wakeley, *Theor Popul Biol* 59:133-144, 2001; Laporte & Charlesworth,. *Genetics* 162: 501-591, 2002). In our analyses, two sources of population subdivision were potentially important: subdivision between continents and subdivision within Africa.

Population subdivision between continents is not large (Tishkoff & Verrelli, *Annu Rev Genomics Hum Genet* 4:293-340, 2003), but it could be sufficient to confound statistics like DT, DF, and F. To test the hypothesis that the presence of the two intermediate-frequency haplotypes in our data is the result of subdivision between continents, we analyzed patterns of genetic differentiation among continental populations by use of the FST statistic, which compares the level of genetic diversity within subpopulations to levels of diversity in the population as a whole (Hartl and Clark, Sinauer Associates, Sunderland, Mass., 1997). In our data, diversity patterns were driven largely by the frequencies of the hsA and hsG haplotypes, which were present at similar frequencies in most populations. The FST value observed among all four continental samples was 0.056. This value is significantly different from zero (P<0.025) but is lower than is typically observed in nuclear genes, which generally have values of 0.15 (Przeworski et al., *Trends Genet* 16:296-302, 2001; Schneider et al., *Mech Ageing Dev* 124:17-25, 2003; Tishkoff & Verrelli, *Annu Rev Genomics Hum Genet* 4:293-340, 2003; Watkins et al., *Genome Res* 13:1607-1618, 2003). This FST value is lower than 80% of those reported for 25,549 SNPs by Akey et al. (*Genome Res* 12:1805-1814, 2002), for instance, and is also lower than 45% of those reported for 1,627 genes by Schneider et al. (*Mech Ageing Dev* 124:17-25, 2003). The latter sample would be expected to have exceptionally low FST values because it included a large number of individuals from admixed populations, such as African-Americans and Hispanic-Latinos. The FST observed in our sample suggests that continental populations are less different with respect to variation in PTC than they are with respect to most other genes, not more different as would be expected if population subdivision or local adaptation had occurred.

Between-continent FST values were strongly affected by the inclusion of the North American sample, owing to the very high frequency of the hsA haplotype (0.95) in that group. The FST value excluding the North American sample was substantially lower than for the sample as a whole: 0.025. This value is significantly greater than zero (P<0.025) but is lower than 75% of FST values reported by Schneider et al. (*Mech Ageing Dev* 124:17-25, 2003) and lower than 90% of values reported by Akey et al. (*Genome Res* 12:1805-1814, 2002). The strong effect of the North American sample could be due to a variety of factors. First, our North American sample is small and may not provide an accurate representation of genetic diversity in North Americans. Estimates of the frequency of nontaster alleles in larger North American samples vary widely (Cavalli-Sforza et al., "The history and geography of human genes," *Princeton University Press, Princeton,* 1994). Second, archaeological and linguistic evidence suggest that North America was not inhabited by humans until recently (15,000 years ago) (*Evol Anthropol* 8:208-227, 1999; Nettle, *Proc Natl Acad Sci USA* 96:3325-3329, 1999), and genetic evidence suggests that North and South American populations descended from a relatively small number of founders that entered the Americas via the Bering Strait (Torroni et al., *Am J Hum Genet* 53:563-590, 1993; Torroni et al., *Am J Hum Genet* 53:591-608, 1993b). Both of these factors can have strong effects on FST values (Urbanek et al., *Mol Biol Evol* 13:943-953, 1996).

Evidence for extensive subdivision has also been found within Africa (Schneider & Excoffier, *Proc Natl Acad Sci USA* 96:10597-10602, 1999; Tishkoff & Williams, *Nat Rev Genet* 3:611-621, 2002; Yu et al., *Genetics* 161:269-274, 2002). As with continental subdivision, subdivision within Africa could inflate DT, DF, and F statistics, yielding a false signature of balancing natural selection. To test the hypothesis that subdivision within the African sample in our study was responsible for the high observed values of these statistics in our sample as a whole, we performed separate DT, DF, and F tests for each continent under the assumptions of (1) no growth and (2) 100-fold growth 100,000 years ago. As shown in Table 6, these statistics were significantly higher than expected in Asia and Europe, even when population growth was not taken into account. Furthermore, the P values of the DT, DF, and F statistics in the African population alone were greater than for the sample as a whole, not lower as would be expected if subdivision within Africa were causing the presence of high overall D values. Thus, substructure in African populations cannot solely explain the high DT values observed in PTC.

TABLE 6

Results of Statistical Tests

| SAMPLE | OBSERVED VALUE FOR STATISTIC | | | P VALUE FOR | | | | | |
|---|---|---|---|---|---|---|---|---|---|
| | | | | No Growth | | | Growth | | |
| | $D_r$ | $D_F$ | F | $D_T$ | $D_F$ | F | $D_T$ | $D_F$ | F |
| Africa | .46 | -.89 | -.56 | .18 | .80 | .56 | .01 | .03 | .01 |
| Asia | 2.94 | -.67 | .57 | .01 | .76 | .28 | .01 | .01 | .01 |

TABLE 6-continued

Results of Statistical Tests

| SAMPLE | OBSERVED VALUE FOR STATISTIC | | | P VALUE FOR | | | | | |
|---|---|---|---|---|---|---|---|---|---|
| | | | | No Growth | | | Growth | | |
| | $D_r$ | $D_F$ | F | $D_T$ | $D_F$ | F | $D_T$ | $D_F$ | F |
| Europe | 2.91 | -.62 | .59 | .01 | .81 | .28 | .01 | .01 | .01 |
| North America | -2.66 | -2.58 | -3.05 | .99 | .99 | .68 | .99 | .91 | .87 |
| All | 1.55 | -1.46 | -.50 | .08 | .90 | .64 | .01 | .01 | .01 |

P values given are the fraction of simulations that yielded a greater value than observed. The "Growth" columns show P values calculated under the assumption that, 100,000 years ago, the human population expanded 100-fold.

Taken together, three lines of evidence suggest that balancing natural selection has acted to maintain high levels of diversity in human populations. First, two haplotypes strongly associated with functionally divergent phenotypes dominate the sample. Second, under reasonable assumptions about human population history, the distribution of polymorphism frequencies in our sample has significantly more intermediate-frequency variants than expected under neutrality (P<0.01). Third, the geographical distribution of the taster and nontaster alleles is not consistent with the hypothesis that they have arisen through population subdivision within or between continents. Thus, R. A. Fisher's hypothesis that balancing natural selection has maintained taster and nontaster alleles appears to hold true in humans (Fisher et al., *Nature* 144:7-50, 1939).

Evidence for balancing selection at the PTC locus does not imply that other selective pressures have been absent. For instance, it is possible that positive natural selection led to the rapid evolution of the nontaster allele, which was then maintained by balancing selection. This possibility might explain the unusually large number of nonsynonymous nucleotide substitutions found in this gene. It is also possible that specific PTC alleles have been favored by positive natural selection in particular environments, resulting in local adaptation. Such effects might account for the high frequency of PTC taster alleles in New World populations and the significant low DT, DF, and F in our North American sample.

The mechanism through which balancing natural selection has maintained divergent PTC alleles in human populations remains unclear. No stop codons or deletions, which might yield nonfunctional alleles, have yet been found at the PTC locus. In addition, although several haplotypes are present in our sample, two account for >90% of observations: hsA and hsG. If nontaster alleles were simply "broken" taster alleles, it seems likely that a greater diversity of nontaster alleles would be expected (Harding et al., *Am J Hum Genet* 66:1351-1361, 2000). One possibility is that PTC heterozygotes gain a fitness advantage through the perception and avoidance of a larger repertoire of bitter toxins than homozygotes. We currently believe that PTC nontaster alleles may encode functional receptor molecules that bind to toxic bitter substances other than PTC.

Example 3

Identification of SNPs in Other T2R Bitter Taste Receptors

Common allelic variants of a member of the TAS2R bitter taste receptor gene family underlie variation in the ability to taste phenylthiocarbamide (PTC). To extend these results to other bitter receptors, we have sequenced 22 of the 24 known TAS2R genes in a series of populations worldwide, including Hungarians, Japanese, Cameroonians, Pygmies, and South American Indians. This example provides description of this analysis, which was used to generate a comprehensive collection of single nucleotide polymorphisms in human T2R putative bitter taste receptors.

Using conventional methods, members of the human T2R family of putative bitter taste receptors were analyzed for the presence of SNPs. All SNPs were identified and analyzed by DNA sequencing. Genomic DNA encoding each receptor was PCR'd using standard methods, and the products cycle sequenced with dye terminators using a Big Dye terminator kit from ABI. Products of the sequencing reactions were analyzed on an ABI 3730x1 DNA Analyzer using the manufactures' recommendations. Other sequencing techniques would be equally applicable to detecting SNPs in these genes.

The results of the comprehensive sequencing are presented in FIG. 1 and Table 7; specific individual variants are also described in the attached Sequence Listing. FIG. 1 shows, in addition to those SNPs confirmed or identified by sequencing reaction, all SNPs found in dbSNP for these genes. See also Tables 7A, 7B, and 7C, below, which show the cSNPs and associated haplotypes.

All 22 T2R genes contain common SNP's within their coding sequence, and we identified an average of 4.4 SNP's per T2R gene. Fifteen variants listed in dbSNP were not observed to be polymorphic in our sample. However, many novel SNPs were identified; these are indicated with the "new" designation in FIG. 1. Of the SNP's we observed (FIG. 1), 77% cause an amino acid substitution in the encoded receptor protein, giving rise to a very high degree of receptor protein variation in the population. Four SNP's specify one allele that introduces an in-frame stop codon in the gene. Some of the SNP's were observed only in individuals of sub-Saharan African origin, and overall African samples displayed higher diversity of alleles. This is consistent with the view that the majority of human genetic variation resides within older African populations, and a fraction of this variation emerged and subsequently spread across the remainder of the world.

Example 4

Worldwide Coding Sequence Variation in Human Bitter Taste Receptors

This example describes the comprehensive evaluation of the worldwide variation in the human bitter taste receptor gene repertoire, and demonstrates that these genes exhibit a high degree of coding sequence diversity. On average these genes contain 4.2 variant amino acid positions, and in aggregate, the 22 genes analyzed specify 109 different protein coding haplotypes. To investigate the effects of natural selection on the bitter taste receptor genes overall, neutrality tests were performed using Tajima's D statistic. Although none of the individual D values departed significantly from expectation, the mean D value was significantly higher than expectation, suggesting either balancing natural selection or population subdivision has affected the frequency of different alleles of these genes. In addition, the mean FST value was significantly greater than expected, indicating that the high D values are attributable to differences between, not within, populations. Unlike the phenylthiocarbamide receptor, which shows evidence of strong balancing selection, other human bitter receptor genes appear to be influenced by local adaptation. It is proposed that these genes have adapted under natural selection imposed by toxic bitter substances produced by plants.

The human T2R38 (PTC) gene has been shown to exist in seven different allelic forms although only two of these, designated the major taster form and the major non-taster form, exist at high frequency outside of sub-Saharan Africa (Example 1 and 2; Wooding, et al., *Am. J. Hum. Genet.* 74:637-646, 2004). These two forms have been shown to be maintained by balancing natural selection, and it has been suggested that the non-taster form serves as a functional receptor for some other bitter substance not yet identified. T2R38 (PTC) studies suggest that there may be substantial additional complexity in the task of identifying specific ligands for each bitter taste receptor, as different alleles of each gene may encode receptors that recognize different ligands. To facilitate the resolution of this problem, we here identify all of the common variants and haplotypes of the nearly complete bitter receptor gene repertoire in humans, and examine population genetic aspects of this variation worldwide. All of the SNPs in T2R43 (see Example 3 and FIG. 1) were found in Cameroonian random individuals. Because parental genotypes were not available for these samples, the haplotypes for T2R43 were not determined in this study.

Materials And Methods

Population samples: Human genomic DNA was obtained from 55 unrelated individuals in 5 different geographic populations including 21 Cameroonians, 10 Amerindians, 10 Japanese, 9 Hungarians, and 5 Pygmies. All DNA samples except Cameroonian were provided by Coriell Cell Repositories.

PCR and DNA sequencing: We sequenced the open reading frame (ORF) of 21 out of 23 human T2R genes and combined this information with data from the T2R38 (PTC) gene published previously (Wooding et al., *Am. J. Hum. Genet.* 74:637-646, 2004). Primers for PCR amplification and for sequencing were designed (using software at the Primer3 Web site) to amplify the entire ORF of each T2R gene in humans.

PCR was performed in a total volume of 25 µl, containing 0.2 µM of each deoxynucleotide (Invitrogen), 15 pmol of each forward and reverse primers, 1.0-1.5 mM of MgCl2, 10 mM Tris-HCl (pH 8.3), 50 mM KCl, 0.75 U of Taq DNA polymerase (PE Biosystems), and 100 ng of genomic DNA. PCR conditions (PE9700, PE Biosystems) were as follows: 35 cycles of denaturation at 94° C. for 30 sec; annealing at 55° C. or 57° C., depending on the primers for 30 sec; and extension at 72° C. for 1 min. The first step of denaturation and the last step of extension were 95° C. for 2 min and 72° C. for 10 min, respectively. Five microliters of the PCR products were separated and visualized in a 2% agarose gel. Fifteen microliters of this PCR product were then treated with 0.3 U of shrimp alkaline phosphatase (USB) and 3 U of exonuclease I (USB) at 37° C. for 1 hr, followed by incubation at 80° C. for 15 min. This was diluted with an equal volume of $dH_2O$, and 6 µl was used for the final sequencing reaction. Sequencing reactions were performed in both directions on the PCR products in reactions containing 5 pmol of primer, 1 µl of Big Dye Terminator Ready Reaction Mix (PE Biosystems), and 1 µl of 5× dilution buffer (400 mM Tris-HCl, pH 9 and 10 mM $MgCl_2$). Cycling conditions were 95° C. for 2 min and 35 cycles of 94° C. for 20 sec, 55° C. for 20 sec, and 60° C. for 4 min. Sequencing reaction products were ethanol precipitated, and the pellets were resuspended in 10 µl of formamide loading dye. An ABI 3730 DNA sequencer was used to resolve the products, and data was analyzed by using ABI Sequencing Analysis (v. 5.0) and LASERGENE-SeqMan software.

Data Analysis: Linkage disequilibrium between pairs of SNPs as estimated using Lewontin's disequilibrium statistic, D' (Lewontin, *Genetics* 50:757-782, 1964). D' values were calculated using the GOLD software package (Abecasis, et al., *Bioinformatics* 16:182-183, 2000). Haplotype and recombination rates between SNP pairs were estimated using the PHASE 2.0.2 computer program (Stephens, et al., *Am. J. Hum. Genet.* 68:978-989, 2001; Stephens, et al., *Am. J. Hum. Genet.* 73:1162-1169, 2003), which implements the methods of Li and Stephens (*Genetics* 165:2213-2233, 2003). This method uses likelihood-based algorithms to estimate a baseline rate of recombination across a region, as well as relative rates of recombination among SNP pairs. Recombination rates were estimated for the two bitter taste receptor gene clusters on chromosomes 7 and 12.

Neutrality tests were conducted using Tajima's D statistic, which compares the mean pairwise difference between randomly chosen sequences in a sample with the number of segregating sites (Tajima, *Genetics* 123:585-595, 1989). We tested the hypothesis of selective neutrality under both the assumption of constant population size and the assumption of 100-fold growth, 100,000 years ago, as described by Wooding et al. (*Am. J. Hum. Genet.* 74:637-646, 2004).

The distribution of Tajima's D values in our sample was tested to determine whether the mean D value in bitter taste receptor genes was significantly greater than expected. This test was performed by simulating 10,000 sets of 21 genes and comparing the mean D value of each simulated dataset with the mean D of the 21 genes in the observed dataset with theoretical expectations under both assumptions. Also, we compared the mean D value observed in the 21 bitter taste receptor genes with empirical expectations based on a set of 160 environmentally responsive genes reported by the NIH environmental Genome Project (EGP). This test was performed by randomly selecting 10,000 subsets of 21 genes from the EGP dataset and comparing the mean D value of each random subset with the mean D in the 21 observed bitter taste receptor genes. The fraction of comparisons in which the D calculated from our data exceeded that in the simulated genes was treated as a one-tailed P-value.

FST values were calculated using the method of Slatkin (*Genetics* 127:627-629, 1991), with continental regions defining subpopulations. Each observed FST value was tested to determine whether it was significantly different from zero using the method of (Excoffier, *Curr. Opin. Genet. Dev.* 12:675-682, 2002). This method compares the observed value of FST with values simulated by randomly allocating individual chromosomes to subpopulations. These tests used 10,000 bootstrap replications.

The distribution of FST values in the bitter taste receptor genes was also tested to determine whether the mean FST in our data was significantly greater than the mean FST of 25,549 SNPs analyzed by Akey et al., which were assembled from The SNP Consortium (TSC) allele frequency project (snp.cshl.org/allele_frequency_project) (Akey et al., *Genome Res.* 12:1805-1814, 2002). These means were compared as follows. First, one random SNP was chosen from each bitter taste receptor gene to form a dataset composed of 21 SNPs. Next, 21 random SNPs were chosen from the TSC dataset. Finally, the FST values calculated for each randomized dataset were compared. This procedure was repeated 10,000 times. The fraction of comparisons in which the FST calculated from our data exceeded that calculated from the TSC data was treated as a one-tailed P-value.

Result and Discussion

We sequenced 21 human T2R (also known as TAS2R) genes to find coding region single nucleotide polymorphisms (cSNPs) using 5 different populations. These genes displayed a very high degree of nucleotide variation ranging from one cSNP in T2R13 to 12 cSNPs in T2R48. Combined with previous results from T2R38 (PTC) gene (Wooding, et al., *Am. J. Hum. Genet.* 74:637-646, 2004), we identified a total of 127 cSNPs in the nearly complete set of T2R genes, with an average of six cSNPs per the gene (detailed in Table 7A, 7B, and 7C). For 32% of cSNPs, the minor allele was observed only once, suggesting they are not common. The Cameroonian population displayed the greatest number of these rare alleles, consistent with the view that African populations harbor higher levels of diversity than do other populations. The remainder of these cSNPs were approximately evenly divided into two classes; 36.2% had a minor allele frequency between 1% and 20%, and the remaining 31.5% had minor allele frequencies between 20% and 50%. FIG. 2 shows the distribution of sharing of cSNPs across these populations. Excluding Pygmies, four populations shared 25 cSNPs although only six cSNPs exist in all the populations studied. In addition, the distribution of allele frequencies in Pygmies is different from other populations, with Pygmies showing reduced polymorphism for the majority of cSNPs found.

TABLE 7A

Bitter Taste Receptor Variants.

| GENE | Total SNPs/ No. NONSY/ No. Haplotypes[1] | LIST OF HAPLOTYPE SEQUENCES | NUMBER (N = 110)[2] | TOTAL FREQUENCY[3] | SEQ ID NO: (NA/AA)[4] |
|---|---|---|---|---|---|
| T2R01 | 3/2/3 | | | | |
| | | GC | 79 | 0.718 | 47/48 |
| | | GT | 5 | 0.045 | 49/50 |
| | | AC | 26 | 0.236 | 51/52 |
| T2R03 | 3/1/2 | | | | |
| | | C | 109 | 0.990 | 53/54 |
| | | T | 1 | 0.010 | 55/56 |
| T2R04 | 8/7/8 | | | | |
| | | GATTCCG | 8 | 0.073 | 57/58 |
| | | GATTCCA | 12 | 0.109 | 59/60 |
| | | GATTCGG | 50 | 0.455 | 61/62 |
| | | GATACCG | 2 | 0.018 | 63/64 |
| | | GACTCCA | 34 | 0.309 | 65/66 |
| | | GACTTCA | 1 | 0.009 | 67/68 |
| | | GCCTCCA | 1 | 0.009 | 69/70 |
| | | AACTCCA | 2 | 0.018 | 71/72 |

TABLE 7A-continued

Bitter Taste Receptor Variants.

| GENE | Total SNPs/ No. NONSY/ No. Haplotypes[1] | LIST OF HAPLOTYPE SEQUENCES | NUMBER (N = 110)[2] | TOTAL FREQUENCY[3] | SEQ ID NO: (NA/AA)[4] |
|---|---|---|---|---|---|
| T2R05 | 7/6/7 | | | | |
| | | GCCAGG | 54 | 0.491 | 73/74 |
| | | GCCAAG | 4 | 0.036 | 75/76 |
| | | GCCGGG | 5 | 0.045 | 77/78 |
| | | GCTAGG | 1 | 0.009 | 79/80 |
| | | TCCAGG | 44 | 0.400 | 81/82 |
| | | TCCAGT | 1 | 0.009 | 83/84 |
| | | TTTAGG | 1 | 0.009 | 85/86 |
| T2R07 | 6/6/5 (INCLUDING 1 STOP) | | | | |
| | | TGCACG | 98 | 0.891 | 87/88 |
| | | TGCACA | 2 | 0.018 | 89/90 |
| | | TGCATG | 3 | 0.027 | 91/92 |
| | | TGTACA | 6 | 0.055 | 93/94 |
| | | CTCTCG | 1 | 0.009 | 95/96 |
| T2R08 | 6/5/6 | | | | |
| | | CTATA | 25 | 0.227 | 97/98 |
| | | CTATG | 80 | 0.727 | 99/100 |
| | | CTACA | 1 | 0.009 | 101/102 |
| | | CTGTG | 2 | 0.018 | 103/104 |
| | | CGATG | 1 | 0.009 | 105/106 |
| | | TTATG | 1 | 0.009 | 107/108 |
| T2R09 | 7/7/8 | | | | |
| | | CCTTGGC | 63 | 0.573 | 109/110 |
| | | CCTTGGA | 2 | 0.018 | 111/112 |
| | | CCTTGTC | 1 | 0.009 | 113/114 |
| | | CCTCGGC | 35 | 0.318 | 115/116 |
| | | CCTCAGC | 1 | 0.009 | 117/118 |
| | | CCATGGC | 3 | 0.027 | 119/120 |
| | | CATTGGC | 2 | 0.018 | 121/122 |
| | | ACTTGGC | 3 | 0.027 | 123/124 |
| T2R10 | 6/3/4 | | | | |
| | | TAT | 98 | 0.891 | 125/126 |
| | | TAC | 1 | 0.009 | 127/128 |
| | | TCT | 1 | 0.009 | 129/130 |
| | | CAT | 10 | 0.091 | 131/132 |
| T2R13 | 1/1/2 | | | | |
| | | A | 75 | 0.682 | 133/134 |
| | | G | 35 | 0.318 | 135/136 |
| T2R14 | 4/2/3 | | | | |
| | | AA | 107 | 0.973 | 137/138 |
| | | AG | 1 | 0.009 | 139/140 |
| | | GA | 2 | 0.018 | 141/142 |
| T2R16 | 8/4/5 | | | | |
| | | GCTA | 67 | 0.609 | 143/144 |
| | | GCTG | 28 | 0.255 | 145/146 |
| | | GCGA | 13 | 0.118 | 147/148 |
| | | GTTA | 1 | 0.009 | 149/150 |
| | | ACTA | 1 | 0.009 | 151/152 |
| T2R38 (PTC) | 5/5/7 | | | | |
| | | CACCG | 184 | 0.558 | 153/154 |
| | | CATCA | 1 | 0.003 | 155/156 |
| | | GGCCA | 1 | 0.003 | 157/158 |
| | | GACCA | 10 | 0.030 | 159/160 |
| | | GACCG | 7 | 0.021 | 161/162 |
| | | GACTA | 1 | 0.003 | 163/164 |
| | | GATCA | 126 | 0.382 | 165/166 |

TABLE 7A-continued

Bitter Taste Receptor Variants.

| GENE | Total SNPs/ No. NONSY/ No. Haplotypes[1] | LIST OF HAPLOTYPE SEQUENCES | NUMBER (N = 110)[2] | TOTAL FREQUENCY[3] | SEQ ID NO: (NA/AA)[4] |
|---|---|---|---|---|---|
| T2R39 | 2/2/2 | | | | |
| | | CA | 107 | 0.973 | 167/168 |
| | | TG | 3 | 0.027 | 169/170 |
| T2R40 | 3/3/5 | | | | |
| | | CAG | 90 | 0.818 | 171/172 |
| | | CAA | 8 | 0.073 | 173/174 |
| | | CGG | 1 | 0.009 | 175/176 |
| | | AAG | 9 | 0.082 | 177/178 |
| | | AGG | 2 | 0.018 | 179/180 |
| T2R41 | 4/2/3 | | | | |
| | | CT | 84 | 0.764 | 181/182 |
| | | CA | 1 | 0.009 | 183/184 |
| | | TT | 25 | 0.227 | 185/186 |
| T2R44 | 11/9/7 | | | | |
| | | TAGCCTACG | 27 | 0.245 | 187/188 |
| | | TAGGCTAGG | 6 | 0.055 | 189/190 |
| | | CAGCCTGCT | 1 | 0.009 | 191/192 |
| | | CAGCCCGCG | 28 | 0.255 | 193/194 |
| | | CTGCCCGCG | 45 | 0.409 | 195/196 |
| | | CTGCTCGCG | 1 | 0.009 | 197/198 |
| | | CTACCCGCG | 2 | 0.018 | 199/200 |
| T2R46 | 6/5/6 (INCLUDING 2 STOPS) | | | | |
| | | TAACC | 22 | 0.204 | 201/202 |
| | | TAAGC | 1 | 0.009 | 203/204 |
| | | TAGCC | 6 | 0.056 | 205/206 |
| | | TTGCC | 75 | 0.694 | 207/208 |
| | | TTGCT | 1 | 0.009 | 209/210 |
| | | GAACC | 3 | 0.028 | 211/212 |
| T2R47 | 5/3/4 | | | | |
| | | AAG | 32 | 0.291 | 213/214 |
| | | AAT | 76 | 0.691 | 215/216 |
| | | AGG | 1 | 0.009 | 217/218 |
| | | GAG | 1 | 0.009 | 219/220 |
| T2R48 | 12/9/9 | | | | |
| | | GCAAATGCT | 33 | 0.300 | 221/222 |
| | | GCAAATGCC | 53 | 0.482 | 223/224 |
| | | GCAAATGTC | 3 | 0.027 | 225/226 |
| | | GCAAATCCT | 1 | 0.009 | 227/228 |
| | | GCCAATGCC | 5 | 0.045 | 229/230 |
| | | GAAAATGTC | 1 | 0.009 | 231/232 |
| | | ACAAATGCC | 12 | 0.109 | 233/234 |
| | | ACAAACGCC | 1 | 0.009 | 235/236 |
| | | ACATGTGCC | 1 | 0.009 | 237/238 |
| T2R49 | 11/9/7 | | | | |
| | | AGCCGATGA | 37 | 0.378 | 239/240 |
| | | AGCCGATGG | 2 | 0.020 | 241/242 |
| | | AGCCAATGA | 1 | 0.010 | 243/244 |
| | | AGCAGATGA | 3 | 0.031 | 245/246 |
| | | AGAAGGCTA | 19 | 0.194 | 247/248 |
| | | AAAAGGCTA | 13 | 0.133 | 249/250 |
| | | GGCCGATGA | 23 | 0.235 | 251/252 |

TABLE 7A-continued

Bitter Taste Receptor Variants.

| GENE | Total SNPs/ No. NONSY/ No. Haplotypes[1] | LIST OF HAPLOTYPE SEQUENCES | NUMBER (N = 110)[2] | TOTAL FREQUENCY[3] | SEQ ID NO: (NA/AA)[4] |
|---|---|---|---|---|---|
| T2R50 | 7/3/4 | | | | |
| | | CGG | 77 | 0.700 | 253/254 |
| | | CGA | 30 | 0.273 | 255/256 |
| | | CTG | 1 | 0.009 | 257/258 |
| | | TGA | 2 | 0.018 | 259/260 |
| T2R60 | 2/1/2 | | | | |
| | | A | 92 | 0.958 | 261/262 |
| | | T | 4 | 0.042 | 263/264 |
| | 127/95/109 (INCLUDING 3 STOP CODON) | | | | |

[1]NONSY - Nonsynonymous Substitution
[2]N - Number examined. N does not apply to T2R38, T2R46, T2R49, T2R60. N of T2R38 = 330; T2R46 = 108; N of T2R49 = 98; N of T2R60 = 96.
[3]Total Frequency = Total FRE of 5 Populations
[4]SEQ ID NO: (NA/AA) - Sequence ID number for Nucleic Acid/Amino Acid. The reference, previously known sequence is indicated in bold; corresponding GenBank Accesion numbers are listed in Table 7C.

TABLE 7B

Haplotype Distribution in Various Populations

| GENE | LIST OF HAPLOTYPES | CAM[1] | AME[1] | JAP[1] | HUN[1] | PYG[1] | Number[2]/ Total Frequency | SEQ ID NO: (NA/AA)[3] |
|---|---|---|---|---|---|---|---|---|
| T2R01 | | | | | | | | |
| | GC | 39 | 6 | 12 | 14 | 8 | 79/0.718 | 47/48 |
| | GT | 0 | 0 | 1 | 2 | 2 | 5/0.045 | 49/50 |
| | AC | 3 | 14 | 7 | 2 | 0 | 26/0.236 | 51/52 |
| T2R03 | | | | | | | | |
| | C | 41 | 20 | 20 | 18 | 10 | 109/0.990 | 53/54 |
| | T | 1 | 0 | 0 | 0 | 0 | 1/0.010 | 55/56 |
| T2R04 | | | | | | | | |
| | GATTCCG | 7 | 0 | 0 | 0 | 1 | 8/0.073 | 57/58 |
| | GATTCCA | 2 | 9 | 1 | 0 | 0 | 12/0.109 | 59/60 |
| | GATTCGG | 22 | 7 | 7 | 8 | 6 | 50/0.455 | 61/62 |
| | GATACCG | 2 | 0 | 0 | 0 | 0 | 2/0.018 | 63/64 |
| | GACTCCA | 8 | 4 | 10 | 10 | 2 | 34/0.309 | 65/66 |
| | GACTTCA | 0 | 0 | 1 | 0 | 0 | 1/0.009 | 67/68 |
| | GCCTCCA | 0 | 0 | 1 | 0 | 0 | 1/0.009 | 69/70 |
| | AACTCCA | 1 | 0 | 0 | 0 | 1 | 2/0.018 | 71/72 |
| T2R05 | | | | | | | | |
| | GCCAGG | 22 | 11 | 7 | 8 | 6 | 54/0.491 | 73/74 |
| | GCCAAG | 4 | 0 | 0 | 0 | 0 | 4/0.036 | 75/76 |
| | GCCGGG | 4 | 0 | 0 | 0 | 1 | 5/0.045 | 77/78 |
| | GCTAGG | 1 | 0 | 0 | 0 | 0 | 1/0.009 | 79/80 |
| | TCCAGG | 9 | 9 | 13 | 10 | 3 | 44/0.400 | 81/82 |
| | TCCAGT | 1 | 0 | 0 | 0 | 0 | 1/0.009 | 83/84 |
| | TTTAGG | 1 | 0 | 0 | 0 | 0 | 1/0.009 | 85/86 |
| T2R07 | | | | | | | | |
| | TGCACG | 39 | 14 | 18 | 17 | 10 | 98/0.891 | 87/88 |
| | TGCACA | 0 | 0 | 1 | 1 | 0 | 2/0.018 | 89/90 |
| | TGCATG | 3 | 0 | 0 | 0 | 0 | 3/0.027 | 91/92 |
| | TGTACA | 0 | 6 | 0 | 0 | 0 | 6/0.055 | 93/94 |
| | CTCTCG | 0 | 0 | 1 | 0 | 0 | 1/0.009 | 95/96 |
| T2R08 | | | | | | | | |
| | CTATA | 19 | 0 | 0 | 0 | 6 | 25/0.227 | 97/98 |
| | CTATG | 20 | 20 | 19 | 17 | 4 | 80/0.727 | 99/100 |
| | CTACA | 1 | 0 | 0 | 0 | 0 | 1/0.009 | 101/102 |
| | CTGTG | 2 | 0 | 0 | 0 | 0 | 2/0.018 | 103/104 |
| | CGATG | 0 | 0 | 0 | 1 | 0 | 1/0.009 | 105/106 |
| | TTATG | 0 | 0 | 1 | 0 | 0 | 1/0.009 | 107/108 |

TABLE 7B-continued

Haplotype Distribution in Various Populations

| GENE | LIST OF HAPLOTYPES | CAM[1] | AME[1] | JAP[1] | HUN[1] | PYG[1] | Number[2]/ Total Frequency | SEQ ID NO: (NA/AA)[3] |
|---|---|---|---|---|---|---|---|---|
| T2R09 | CCTTGGC | 27 | 16 | 5 | 10 | 5 | 63/0.573 | 109/110 |
| | CCTTGGA | 2 | 0 | 0 | 0 | 0 | 2/0.018 | 111/112 |
| | CCTTGTC | 1 | 0 | 0 | 0 | 0 | 1/0.009 | 113/114 |
| | CCTCGGC | 6 | 4 | 14 | 8 | 3 | 35/0.318 | 115/116 |
| | CCTCAGC | 0 | 0 | 1 | 0 | 0 | 1/0.009 | 117/118 |
| | CCATGGC | 3 | 0 | 0 | 0 | 0 | 3/0.027 | 119/120 |
| | CATTGGC | 0 | 0 | 0 | 0 | 2 | 2/0.018 | 121/122 |
| | ACTTGGC | 3 | 0 | 0 | 0 | 0 | 3/0.027 | 123/124 |
| T2R10 | TAT | 31 | 20 | 20 | 18 | 9 | 98/0.891 | 125/126 |
| | TAC | 0 | 0 | 0 | 0 | 1 | 1/0.009 | 127/128 |
| | TCT | 1 | 0 | 0 | 0 | 0 | 1/0.009 | 129/130 |
| | CAT | 10 | 0 | 0 | 0 | 0 | 10/0.091 | 131/132 |
| T2R13 | A | 40 | 10 | 5 | 10 | 10 | 75/0.682 | 133/134 |
| | G | 2 | 10 | 15 | 8 | 0 | 35/0.318 | 135/136 |
| T2R14 | AA | 40 | 20 | 19 | 18 | 10 | 107/0.973 | 137/138 |
| | AG | 0 | 0 | 1 | 0 | 0 | 1/0.009 | 139/140 |
| | GA | 2 | 0 | 0 | 0 | 0 | 2/0.018 | 141/142 |
| T2R16 | GCTA | 23 | 16 | 11 | 9 | 8 | 67/0.609 | 143/144 |
| | GCTG | 6 | 4 | 9 | 9 | 0 | 28/0.255 | 145/146 |
| | GCGA | 12 | 0 | 0 | 0 | 1 | 13/0.118 | 147/148 |
| | GTTA | 0 | 0 | 0 | 0 | 1 | 1/0.009 | 149/150 |
| | ACTA | 1 | 0 | 0 | 0 | 0 | 1/0.009 | 151/152 |
| T2R38 (PTC) | CACCG | | | | | | N = 330 184/0.558 | 153/154 |
| | CATCA | | | | | | 1/0.003 | 155/156 |
| | GGCCA | | | | | | 1/0.003 | 157/158 |
| | GACCA | | | | | | 10/0.030 | 159/160 |
| | GACCG | | | | | | 7/0.021 | 161/162 |
| | GACTA | | | | | | 1/0.003 | 163/164 |
| | GATCA | | | | | | 126/0.382 | 165/166 |
| T2R39 | CA | 39 | 20 | 20 | 18 | 10 | 107/0.973 | 167/168 |
| | TG | 3 | 0 | 0 | 0 | 0 | 3/0.027 | 169/170 |
| T2R40 | CAG | 33 | 12 | 20 | 16 | 9 | 90/0.818 | 171/172 |
| | CAA | 0 | 8 | 0 | 0 | 0 | 8/0.073 | 173/174 |
| | CGG | 1 | 0 | 0 | 0 | 0 | 1/0.009 | 175/176 |
| | AAG | 6 | 0 | 0 | 2 | 1 | 9/0.082 | 177/178 |
| | AGG | 2 | 0 | 0 | 0 | 0 | 2/0.018 | 179/180 |
| T2R41 | CT | 41 | 13 | 11 | 9 | 10 | 84/0.764 | 181/182 |
| | CA | 1 | 0 | 0 | 0 | 0 | 1/0.009 | 183/184 |
| | TT | 0 | 7 | 9 | 9 | 0 | 25/0.227 | 185/186 |
| T2R44 | TAGCCTACG | 6 | 10 | 4 | 7 | 0 | 27/0.245 | 187/188 |
| | TAGGCTAGG | 1 | 0 | 0 | 5 | 0 | 6/0.055 | 189/190 |
| | CAGCCTGCT | 1 | 0 | 0 | 0 | 0 | 1/0.009 | 191/192 |
| | CAGCCCGCG | 0 | 10 | 14 | 4 | 0 | 28/0.255 | 193/194 |
| | CTGCCCGCG | 32 | 0 | 2 | 2 | 9 | 45/0.409 | 195/196 |
| | CTGCTCGCG | 0 | 0 | 0 | 0 | 1 | 1/0.009 | 197/198 |
| | CTACCCGCG | 2 | 0 | 0 | 0 | 0 | 2/0.018 | 199/200 |
| T2R46 | TAACC | 3 | 10 | 3 | 6 | 0 | N = 108 22/0.204 | 201/202 |
| | TAAGC | 0 | 0 | 1 | 0 | 0 | 1/0.009 | 203/204 |
| | TAGCC | 1 | 0 | 0 | 5 | 0 | 6/0.056 | 205/206 |
| | TTGCC | 34 | 10 | 16 | 5 | 10 | 75/0.694 | 207/208 |
| | TTGCT | 1 | 0 | 0 | 0 | 0 | 1/0.009 | 209/210 |
| | GAACC | 3 | 0 | 0 | 0 | 0 | 3/0.028 | 211/212 |

TABLE 7B-continued

Haplotype Distribution in Various Populations

| GENE | LIST OF HAPLOTYPES | CAM[1] | AME[1] | JAP[1] | HUN[1] | PYG[1] | Number[2]/ Total Frequency | SEQ ID NO: (NA/AA)[3] |
|---|---|---|---|---|---|---|---|---|
| T2R47 | | | | | | | | |
| | AAG | 7 | 10 | 4 | 11 | 0 | 32/0.291 | 213/214 |
| | AAT | 34 | 10 | 16 | 6 | 10 | 76/0.691 | 215/216 |
| | AGG | 1 | 0 | 0 | 0 | 0 | 1/0.009 | 217/218 |
| | GAG | 0 | 0 | 0 | 1 | 0 | 1/0.009 | 219/220 |
| T2R48 | | | | | | | | |
| | GCAAATGCT | 7 | 10 | 4 | 12 | 0 | 33/0.300 | 221/222 |
| | GCAAATGCC | 21 | 6 | 15 | 6 | 5 | 53/0.482 | 223/224 |
| | GCAAATGTC | 0 | 0 | 0 | 0 | 3 | 3/0.027 | 225/226 |
| | GCAAATCCT | 1 | 0 | 0 | 0 | 0 | 1/0.009 | 227/228 |
| | GCCAATGCC | 0 | 4 | 1 | 0 | 0 | 5/0.045 | 229/230 |
| | GAAAATGTC | 0 | 0 | 0 | 0 | 1 | 1/0.009 | 231/232 |
| | ACAAATGCC | 11 | 0 | 0 | 0 | 1 | 12/0.109 | 233/234 |
| | ACAAACGCC | 1 | 0 | 0 | 0 | 0 | 1/0.009 | 235/236 |
| | ACATGTGCC | 1 | 0 | 0 | 0 | 0 | 1/0.009 | 237/238 |
| T2R49 | | | | | | | N = 98 | |
| | AGCCGATGA | 23 | 0 | 0 | 6 | 8 | 37/0.378 | 239/240 |
| | AGCCGATGG | 2 | 0 | 0 | 0 | 0 | 2/0.020 | 241/242 |
| | AGCCAATGA | 1 | 0 | 0 | 0 | 0 | 1/0.010 | 243/244 |
| | AGCAGATGA | 3 | 0 | 0 | 0 | 0 | 3/0.031 | 245/246 |
| | AGAAGGCTA | 1 | 6 | 9 | 3 | 0 | 19/0.194 | 247/248 |
| | AAAAGGCTA | 1 | 4 | 7 | 1 | 0 | 13/0.133 | 249/250 |
| | GGCCGATGA | 3 | 10 | 4 | 6 | 0 | 23/0.235 | 251/252 |
| T2R50 | | | | | | | | |
| | CGG | 40 | 10 | 4 | 13 | 10 | 77/0.700 | 253/254 |
| | CGA | 1 | 10 | 14 | 5 | 0 | 30/0.273 | 255/256 |
| | CTG | 1 | 0 | 0 | 0 | 0 | 1/0.009 | 257/258 |
| | TGA | 0 | 0 | 2 | 0 | 0 | 2/0.018 | 259/260 |
| T2R60 | | | | | | | N = 96 | |
| | A | 27 | 20 | 20 | 18 | 7 | 92/0.958 | 261/262 |
| | T | 3 | 0 | 0 | 0 | 1 | 4/0.042 | 263/264 |

NOTES:
[1] CAM = Cameroonian; AME = Amerindian; JAP = Japanese; HUN = Hungarian; PYG = Pygmy
[2] N = number examined (110 unless otherwise indicated). Total Frequency = Total FRE of 5 Populations
[4] SEQ ID NO: (NA/AA) - Sequence ID number for Nucleic Acid/Amino Acid.

TABLE 7C

Relationship of T2R Haplotypes to GenBank Reference Sequence

| Gene NA position | GenBank Accession NA Variants | GenBank Allele AA position | GenBank Sequence SEQ ID NOs. (NA/AA)[1] AA Variants |
|---|---|---|---|
| T2R01 | AF227129 | GC | 47/48 |
| 332 | G/A | 111 | Arg/His |
| 616 | C/T | 206 | Arg/Trp |
| T2R03 | AF227130 | C | 53/54 |
| 349 | C/T | 117 | Pro/Ser |
| T2R04 | AF227131 | GATTCGG | 61/62 |
| 8 | G/A | 3 | Arg/Gln |
| 17 | A/C | 6 | Tyr/Ser |
| 20 | T/C | 7 | Phe/Ser |
| 186 | T/A | 62 | Phe/Leu |
| 221 | C/T | 74 | Thr/Met |
| 268 | C/G | 96 | Leu/Val |
| 512 | G/A | 171 | Ser/Asn |
| T2R05 | AF227132 | GCCAGG | 73/74 |
| 77 | G/T | 26 | Ser/Ile |
| 235 | C/T | 79 | Arg/Cys |
| 338 | C/T | 113 | Pro/Leu |
| 500 | A/G | 167 | Tyr/Cys |
| 638 | G/A | 213 | Arg/Gln |
| 881 | G/T | 294 | Arg/Leu |
| T2R07 | AF227133 | TGCACG | 87/88 |
| 254 | T/C | 85 | Ile/Thr |
| 538 | G/T | 180 | Ala/Ser |
| 640 | C/T | 214 | Arg/Stop |
| 787 | A/T | 263 | Thr/Ser |
| 788 | C/T | 263 | Thr/Met |
| 912 | G/A | 304 | Met/Ile |
| T2R08 | AF227134 | CTATA | 97/98 |
| 142 | C/T | 48 | Leu/Phe |
| 370 | T/G | 124 | Trp/Gly |
| 496 | A/G | 166 | Arg/Gly |
| 829 | T/C | 277 | Tyr/His |
| 922 | A/G | 308 | Met/Val |
| T2R09 | AF227135 | CCTTGGC | 109/110 |
| 201 | C/A | 67 | Phe/Leu |
| 381 | C/A | 127 | Asn/Lys |

TABLE 7C-continued

Relationship of T2R Haplotypes to GenBank Reference Sequence

| Gene NA position | GenBank Accession | GenBank Allele AA position | GenBank Sequence SEQ ID NOs.(NA/AA)[1] AA Variants |
|---|---|---|---|
| 450 | T/A | 150 | Asp/Glu |
| 560 | T/C | 187 | Val/Ala |
| 697 | G/A | 233 | Ala/Thr |
| 867 | G/T | 289 | Leu/Phe |
| 880 | C/A | 294 | Leu/Met |
| T2R10 | AF227136 | CAT | 131/132 |
| 467 | T/C | 156 | Met/Thr |
| 521 | A/C | 174 | Lys/Thr |
| 691 | T/C | 231 | Ser/Pro |
| T2R13 | AF227137 | A | 133/134 |
| 776 | A/G | 259 | Asn/Ser |
| T2R14 | AF227138 | AA | 137/138 |
| 256 | A/G | 86 | Thr/Ala |
| 589 | A/G | 197 | Met/Val |
| T2R16 | AF227139 | GCTG | 145/146 |
| 301 | G/A | 101 | Val/Met |
| 481 | C/T | 161 | Pro/Ser |
| 516 | T/G | 172 | Asn/Lys |
| 665 | A/G | 222 | His/Arg |
| T2R38 | AF494231 | GATCA | 165/166 |
| 145 | C/G | 49 | Pro/Ala |
| 239 | A/G | 80 | His/Arg |
| 785 | C/T | 262 | Ala/Val |
| 820 | C/T | 274 | Arg/Cys |
| 886 | G/A | 296 | Val/Ile |
| T2R39 | AF494230 | CA | 167/168 |
| 578 | C/T | 193 | Ser/Phe |
| 589 | A/G | 197 | Lys/Glu |
| T2R40 | AF494229 | CAG | 171/172 |
| 560 | C/A | 187 | Ser/Tyr |
| 817 | A/G | 273 | Thr/Ala |
| 871 | G/A | 291 | Gly/Ser |
| T2R41 | AF494232 | TT | 185/186 |
| 380 | C/T | 127 | Pro/Leu |
| 584 | T/A | 195 | Val/Asp |
| T2R44 | AF494228 | CAGCCCGCG | 193/194 |
| 103 | T/C | 35 | Trp/Arg |
| 484 | A/T | 162 | Met/Leu |
| 599 | G/A | 200 | Cys/Tyr |
| 649 | C/G | 217 | Gln/Glu |
| 656 | C/T | 219 | Pro/Leu |
| 680 | T/C | 227 | Val/Ala |
| 718 | A/G | 240 | Ile/Val |
| 827 | C/G | 276 | Pro/Arg |
| 843 | G/T | 281 | Trp/Cys |
| T2R46 | AF494227 | TTGCC | 207/208 |
| 106 | T/G | 36 | Phe/Val |
| 682 | A/T | 228 | Met/Leu |
| 749 | A/G | 250 | Stop/Trp |
| 834 | C/G | 278 | Ile/Met |
| 862 | C/T | 288 | Gln/Stop |
| T2R47 | AF494233 | AAT | 215/216 |
| 521 | A/G | 174 | His/Arg |
| 577 | A/G | 193 | Ile/Val |
| 756 | G/T | 252 | Leu/Phe |
| T2R48 | AF494234 | GCAAATGCC | 223/224 |
| 94 | G/A | 32 | Val/Ile |
| 113 | C/T | 38 | Thr/Lys |
| 376 | A/C | 126 | Lys/Gln |
| 456 | A/T | 152 | Arg/Ser |
| 673 | A/G | 225 | Ile/Val |
| 719 | T/C | 240 | Ile/Thr |
| 799 | G/C | 267 | Val/Leu |
| 815 | C/T | 272 | Pro/Leu |
| 895 | T/C | 299 | Cys/Arg |
| T2R49 | AF494236 | AGCCGATGA | 239/240 |
| 235 | A/G | 79 | Lys/Glu |
| 421 | G/A | 141 | Val/Ile |
| 429 | C/A | 143 | His/Gln |
| 442 | C/A | 148 | His/Asn |
| 516 | G/A | 172 | Met/Ile |
| 706 | A/G | 236 | Ile/Val |
| 755 | T/C | 252 | Phe/Ser |
| 764 | G/T | 255 | Arg/Leu |
| 808 | A/G | 270 | Ile/Val |
| T2R50 | AF494235 | CGA | 255/256 |
| 155 | C/T | 52 | Ala/Val |
| 181 | G/T | 61 | Ala/Ser |
| 608 | G/A | 203 | Cys/Tyr |
| T2R60 | AY114094 | A | 261/262 |
| 595 | A/T | 199 | Met/Leu |

[1]SEQ ID NO: (NA/AA) - Sequence ID number for Nucleic Acid/Amino Acid

Of the cSNPs found, 92(72%) are nonsynonymous and 32(25%) are synonymous. 42.5% of nonsynonymous substitutions are non-conservative, and amino acid changes were observed across the entire coding region of these genes. Interestingly, we observed two segregating pseudogenes (SPGs); that is, T2R genes for which both intact and nonsense versions (null alleles) were segregating in the human sample. One is the T2R46 gene, which has two nonsense alleles, G749A and C862T. G749A has a null allele frequency of ~24% in all populations except Pygmy, while C862T was observed only once, in Cameroonians. The other SPG was observed in T2R7 and although it was observed only in Amerindians, the null allele displayed a frequency of 30% in this population. Although only two SPGs seem to exist in the entire repertoire of T2R genes, our result is consistent with observations in the olfactory receptor gene family, and suggests that T2R SPGs exist at different frequencies in different populations (Menashe et al., *Hum. Mol. Genet.* 11:1381-1390, 2002; Gilad, et al., *Mol. Biol. Evol.* 20:307-314, 2002).

Given the fact that different combinations of each polymorphic site in a bitter receptor gene can explain the phenotypic variation for a bitter compound in humans (Kim, et al., *Science* 299:1221-1225, 2003), we inferred possible functional haplotypes with nonsynonymous substitutions of each gene using Bayesian methods as implemented in the Phase package. In the 20 T2R genes that contain at least two cSNPs specifying amino acid change, we identified 109 different haplotypes. The number of haplotypes ranged from 2 to 9 for each gene. With the exception of T2R44 and T2R49, the most common haplotype of each gene was consistent across populations, and was observed in all five different populations.

To investigate the effects of natural selection on the bitter taste receptor genes as a group, we performed neutrality tests using Tajima's D statistic. Tajima's D compares the mean pairwise difference between randomly chosen sequences in a sample with the number of segregating sites (Tajima, *Genetics* 123:585-595, 1989). Tajima's D test is usually performed under the assumption that population size has been constant. However, much evidence suggests that modern human populations are the product of an expansion that took place around 100,000 years ago, during which the human population soared from an initial effective size of roughly 10,000 (Excoffier, *Curr. Opin. Genet. Dev.* 12:675-682, 2002; Klein, *The Human Career: Human Biological and Cultural Origins*, 1999; Harpending, et al., *Annu. Rev. Genomics Hum. Genet.* 1:361-385, 2000; Tishkoff, et al., *Annu. Rev. Genomics Hum. Genet.* 4:293-340, 2003). Such growth is important to consider in neutrality tests because it can both mimic the effects of positive selection (i.e., selective sweeps) and obscure the effects of balancing selection (e.g. heterozygote advantage) (Bamshad, et al., *Nat. Rev. Genet.* 4:99-111, 2003). For this reason, we tested the hypothesis of selective neutrality under both the assumption of constant population size and the assumption of 100-fold growth, 100,000 y ears ago, as described by Wooding et al. (*Am. J. Hum. Genet.* 74:637-646, 2004).

When considered individually, only two bitter taste genes, T2R16 and T2R49, showed significant departures from neutrality under both the assumption of constant population size and the assumption of population growth (Table 8). T2R16 had a highly negative D-value (−2.152, P<0.01 under growth) and T2R49 had a highly positive D-value (1.856, P<0.005 under growth). One additional gene, T2R13, showed a significant positive departure from expectation only under the assumption of population growth (p<0.025). Three more T2R4, T2R44, and T2R60 had D values that were high but not statistically significant under either model. When multiple comparisons were taken into account using a Bonferroni correction, none of the D values departed significantly from expectation, although under growth the D value for T2R49 failed to reach significance only marginally.

TABLE 8

Summary statistics for T2Rs

| T2R# | Seg. | mpd | π (%) | $F_{ST}$ | D | Prob (Dsim > Dobs) No Growth | Prob (Dsim > Dobs) Growth |
|---|---|---|---|---|---|---|---|
| 1 | 3 | 0.047 | 0.005 | 0.233 | −1.618 | 0.995 | 0.912 |
| 3 | 3 | 0.545 | 0.057 | 0.103 | −0.074 | 0.541 | 0.201 |
| 4 | 8 | 1.701 | 0.189 | 0.065 | 0.289 | 0.301 | 0.126 |
| 5 | 7 | 0.973 | 0.109 | 0.067 | −0.616 | 0.640 | 0.424 |
| 7 | 6 | 0.348 | 0.036 | 0.127 | −1.536 | 0.991 | 0.875 |
| 8 | 6 | 0.906 | 0.097 | 0.275 | −0.451 | 0.649 | 0.349 |
| 9 | 7 | 0.642 | 0.068 | 0.141 | −1.193 | 0.915 | 0.717 |
| 10 | 6 | 0.568 | 0.061 | 0.136 | −1.108 | 0.906 | 0.689 |
| 13 | 1 | 0.438 | 0.048 | 0.341 | 1.473 | 0.095 | 0.010 |
| 14 | 4 | 0.544 | 0.057 | 0.469 | −0.552 | 0.635 | 0.349 |
| 16 | 8 | 0.152 | 0.017 | 0.150 | −2.152 | 1.000 | 0.996 |
| 39 | 2 | 0.107 | 0.011 | 0.021 | −1.084 | 0.896 | 0.671 |
| 40 | 3 | 0.371 | 0.038 | 0.148 | −0.614 | 0.690 | 0.429 |
| 41 | 4 | 0.745 | 0.081 | 0.231 | −0.035 | 0.517 | 0.204 |
| 44 | 11 | 2.500 | 0.269 | 0.239 | 0.511 | 0.233 | 0.078 |
| 46 | 6 | 0.975 | 0.105 | 0.117 | −0.317 | 0.588 | 0.287 |
| 47 | 5 | 0.917 | 0.096 | 0.156 | −0.068 | 0.499 | 0.217 |
| 48 | 12 | 1.848 | 0.205 | 0.257 | −0.493 | 0.676 | 0.354 |
| 49 | 11 | 3.590 | 0.386 | 0.327 | 1.856 | 0.031 | 0.005 |
| 50 | 7 | 1.269 | 0.141 | 0.246 | −0.102 | 0.531 | 0.221 |
| 60 | 2 | 0.515 | 0.054 | 0.236 | 0.540 | 0.243 | 0.076 |

Column headings are as follows;
T2R#, bitter taste receptor gene (e.g., 1 = T2R01);
Seg., Number of polymorphic nucleotide positions;
mpd, mean pairwise difference among randomly chosen sequences;
pi, mean pairwise difference per nucleotide;
D, Tajima's D statistic calculated from Seg. and mpd (n = 110);
Prob (Dsim > Dobs), probability that a D value simulated under the given model exceeded the observed value.
No growth indicates that simulations assumed a constant human population size.
Growth indicates that simulations assumed that the human population size increased from 10,000 to 1,000,000, 100,000 years ago.

Figure 3:
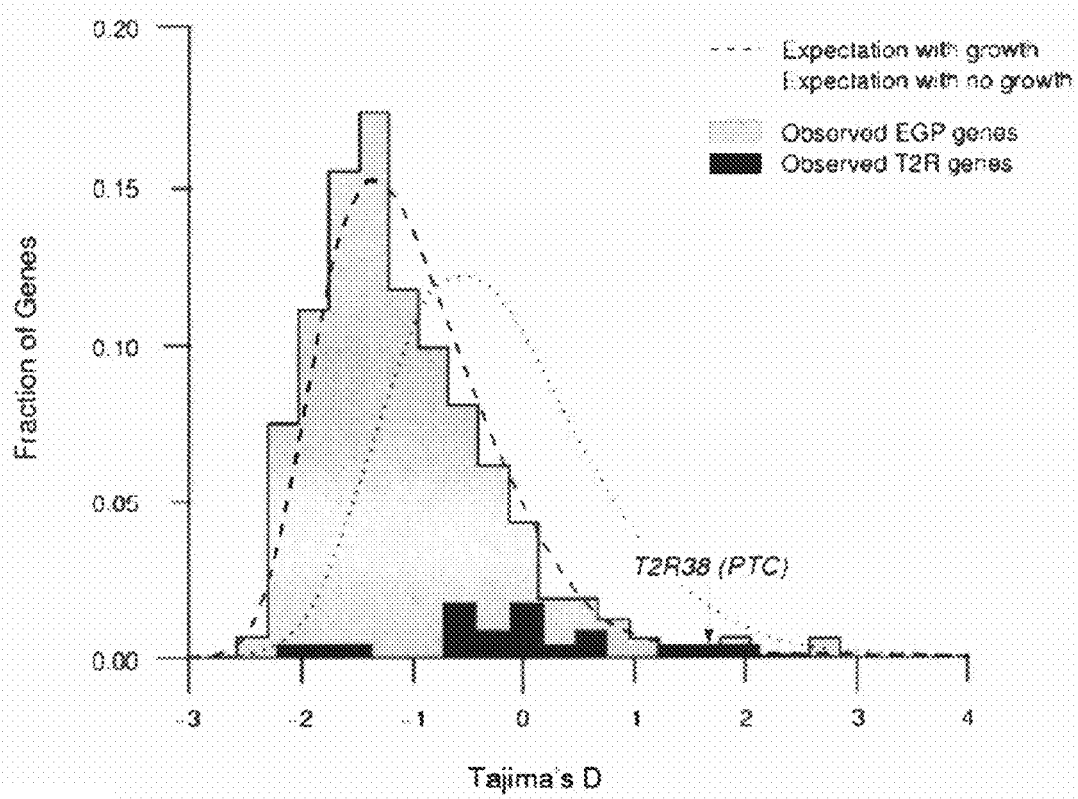
FIG. 3 is a graph showing the distributions of Tajima's D statistic. Dotted line indicates theoretical expectation under the assumption that human population sizes have been constant. Dashed line indicates theoretical expectation under the assumption that the human population sizes increased from 10,000 to 1,000,000, 100,000 years ago. Observed fractions were calculated across all genes (EGP and T2R). EGP genes were resequenced in the 90-member NIH polymorphism discovery resource as part of the Environmental Genome Project. These genes encode proteins thought to be important in mediating the interface between the human body and the environment. Observed T2R genes are the genes resequenced for this study.

Although none of the individual D values in our sample departed significantly from expectation, the distribution of D values did. When we compared the mean D value observed in the 21 bitter taste receptor genes with theoretical expectations under the assumptions of (i) no population growth, and (ii) 100-fold growth, 100,000 years ago, the mean D value observed in our sample (−0.35) differed significantly from expectation under growth (−0.67) (P<0.01). Further, bootstrap resampling tests showed that the mean observed D value was significantly greater than the mean D value (−1.00) in 160 genes resequenced as part of the NIH Environmental Genome Project (EGP). The EGP genes provide an appropriate comparison because they, like the taste receptors in our sample, are thought to be particularly important in mediating interactions between the human body and its environment (Wakefield, *Environ. Health Perspect* 110:A757-759, 2002). As shown in FIG. 3, the EGP genes showed a distribution of D values similar to that expected under the assumption of 100-fold growth, 100,000 years ago. Thus, not only is the average D value in the bitter taste receptors significantly greater than expected under reasonable assumptions about human population history (i.e., growth), it is significantly greater than expected given a large sample of comparable genes (i.e., environmentally responsive genes).

High values of Tajima's D are caused by a relative overabundance of SNPs with intermediate frequencies (i.e., frequencies near 50%). Such values often indicate the presence of balancing natural selection; however, high D values can also be caused by population subdivision (Bamshad, et al., *Nat. Rev. Genet.* 4:99-111, 2003). To distinguish these alternatives we analyzed the FST statistic, which takes values near zero in the absence of population differentiation and values near unity in the presence of extreme differentiation. FST values in our sample ranged from 0.02 to 0.47, with a mean of 0.25. Published FST values based on DNA sequence variation in humans are usually lower, often falling around 0.15 (Tishkoff et al., *Annu. Rev. Genomics Hum. Genet.* 4:293-340, 2003). For example, in a study of 25,549 SNPs, Akey et al. found an average FST of 0.123 (*Genome Res.* 12:1805-1814, 2002). Bootstrap tests showed that the mean value observed in our dataset is significantly higher than that in the TSC dataset. The preponderance of high FST values in our sample suggests that human populations differ more with respect to variation in the bitter taste receptor genes than they do with respect to most other regions of the genome.

Figure 4:
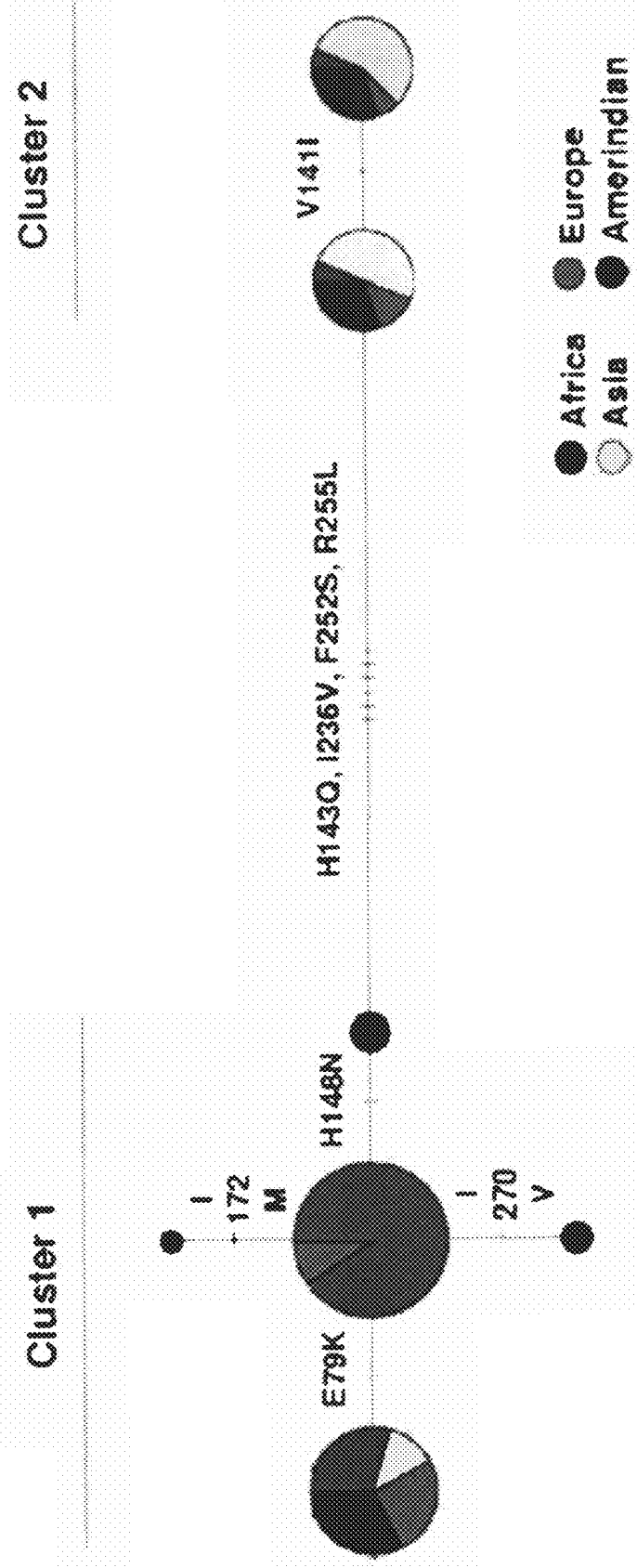
FIG. 4 is a minimum spanning tree of T2R49 haplotypes. Each circle represents a haplotype, the area of the circle represents the haplotype frequency, and shading indicates the fraction at which the haplotype was observed in each continental sample. Each slash represents one nucleotide substitution. Amino acid substitutions are denoted with letter-number combinations. Europe and Africa are dominated by Cluster 1 while Asia and Amerindian are dominated by Cluster 2.

The patterns of genetic variation found in the bitter taste receptor genes in general are illustrated by the T2R49 gene. Among the genes we examined, T2R49 had the highest value of Tajima's D (1.86) and the third highest FST (0.33). The value of Tajima's D in T2R49 is significantly greater than expected (P<0.05 under constant population size, P<0.01 under growth). The FST value is significantly greater than zero (P<0.01) and exceeds more than 85% of the FST values reported by Akey et al. (*Genome Res.* 12:1805-1814, 2002). A minimum spanning tree relating T2R49 haplotypes showed that two common, distinct haplotype clusters differing from each other by six nucleotide substitutions (including four amino acid substitutions) were present. The presence of two common, but distinct, clusters causes a high value of Tajima's D at this locus. As shown in FIG. 4, each cluster was common in a different geographical region. While cluster 1 accounted for 91.5% of observations in Africa and Europe, cluster 2 accounted for 65.0% of observations in Asia and Amerindians. The high frequency of each cluster in a different geographical region causes a high FST value at this locus. Further, nine out of 11 nucleotide substitutions in T2R49 cause amino acid substitutions. This ratio is extremely high compared to that observed in most genes, and is consistent with the hypothesis that positive natural selection has been active in the region (McDonald, et al., *Nature* 351:652-654, 1991; Nekrutenko, et al., *Genome Res.* 12:198-202, 2002).

Example 5

Detecting Single Nucleotide Alterations

T2R bitter taste receptor single nucleotide alterations, whether categorized as SNPs or new mutations can be detected by a variety of techniques in addition to merely sequencing the target sequence. Constitutional single nucleotide alterations can arise either from new germline mutations, or can be inherited from a parent who possesses a SNP or mutation in their own germline DNA. The techniques used in evaluating either somatic or germline single nucleotide alterations include hybridization using allele specific oligonucleotides (ASOs) (Wallace et al., *CSHL Symp. Quant. Biol.* 51:257-261, 1986; Stoneking et al., *Am. J. Hum. Genet.* 48:370-382, 1991), direct DNA sequencing (Church and Gilbert, *Proc. Natl. Acad. Sci. USA* 81:1991-1995, 1988), the use of restriction enzymes (Flavell et al., *Cell* 15:25, 1978; Geever et al., 1981), discrimination on the basis of electrophoretic mobility in gels with denaturing reagent (Myers and Maniatis, Cold Spring Harbor Symp. Quant. Biol. 51:275-284, 1986), RNase protection (Myers et al., *Science* 230: 1242, 1985), chemical cleavage (Cotton et al., *Proc. Natl. Acad. Sci. USA* 85:4397-4401, 1985), and the ligase-mediated detection procedure (Landegren et al., *Science* 241:1077, 1988).

Allele-specific oligonucleotide hybridization (ASOH) involves hybridization of probes to the sequence, stringent washing, and signal detection. Other new methods include techniques that incorporate more robust scoring of hybridization. Examples of these procedures include the ligation chain reaction (ASOH plus selective ligation and amplification), as disclosed in Wu and Wallace (*Genomics* 4:560-569, 1989); mini-sequencing (ASOH plus a single base extension) as discussed in Syvanen (*Meth. Mol. Biol.* 98:291-298, 1998); and the use of DNA chips (miniaturized ASOH with multiple oligonucleotide arrays) as disclosed in Lipshutz et al. (*BioTechniques* 19:442-447, 1995). Alternatively, ASOH with single- or dual-labeled probes can be merged with PCR, as in the 5'-exonuclease assay (Heid et al., *Genome Res.* 6:986-994, 1996), or with molecular beacons (as in Tyagi and Kramer, *Nat. Biotechnol.* 14:303-308, 1996).

Another technique is dynamic allele-specific hybridization (DASH), which involves dynamic heating and coincident monitoring of DNA denaturation, as disclosed by Howell et al. (*Nat. Biotech.* 17:87-88, 1999). A target sequence is amplified by PCR in which one primer is biotinylated. The biotinylated product strand is bound to a streptavidin-coated microtiter plate well, and the non-biotinylated strand is rinsed away with alkali wash solution. An oligonucleotide probe, specific for one allele, is hybridized to the target at low temperature. This probe forms a duplex DNA region that interacts with a double strand-specific intercalating dye. When subsequently excited, the dye emits fluorescence proportional to the amount of double-stranded DNA (probe-target duplex) present. The sample is then steadily heated while fluorescence is continually monitored. A rapid fall in fluorescence indicates the denaturing temperature of the probe-target duplex. Using this technique, a single-base mismatch between the probe and target results in a significant lowering of melting temperature ($T_m$) that can be readily detected.

Oligonucleotides specific to normal or allelic sequences can be chemically synthesized using commercially available machines. These oligonucleotides can then be labeled radioactively with isotopes (such as $^{32}P$) or non-radioactively, with tags such as biotin (Ward and Langer et al., *Proc. Natl. Acad. Sci. USA* 78:6633-6657, 1981), and hybridized to individual DNA samples immobilized on membranes or other solid supports by dot-blot or transfer from gels after electrophoresis. These specific sequences are visualized by methods such as autoradiography or fluorometric (Landegren et al., *Science* 242:229-237, 1989) or calorimetric reactions (Gebeyehu et al., *Nucleic Acids Res.* 15:4513-4534, 1987). Using an ASO specific for a normal allele, the absence of hybridization would indicate a mutation in the particular region of the gene, or a deleted gene. In contrast, if an ASO specific for a mutant allele hybridizes to a sample then that would indicate the presence of a mutation in the region defined by the ASO.

A variety of other techniques can be used to detect the mutations or other variations in DNA. Merely by way of example, see U.S. Pat. Nos. 4,666,828; 4,801,531; 5,110,920; 5,268,267; 5,387,506; 5,691,153; 5,698,339; 5,736,330; 5,834,200; 5,922,542; and 5,998,137 for such methods. Additional methods include fluorescence polarization methods such as those developed by Pui Kwok and colleagues (see, e.g., Kwok, *Hum. Mutat.*, 19(4):315-23, 2002), microbead methods such as those developed by Mark Chee at Illumina (see, e.g., Oliphant et al., *Biotechniques.* 2002 June; Suppl: 56-8, 60-61, Shen et al., *Genet. Eng. News,* 23(6), 2003), and mass spectrophotometery methods such as those being developed at Sequenom (on the Web at sequenom.com) (see, e.g., Jurinke et al., *Methods Mol Biol.* 187:179-92, 2002; Amexis et al., *Proc Natl Acad Sci USA* 98(21): 12097-102, 2001; Jurinke et al., *Adv Biochem Eng Biotechnol.* 2002;77:57-74; Storm et al., *Meth. Mol. Biol.,* 212:241 262, 2002; Rodi et al., *BioTechniques.,* 32:S62 S69, 2002); U.S. Pat. No. 6,300,076; and WO9820166).

Example 6

Differentiation of Individuals Homozygous Versus Heterozygous for Mutation(s)

Since it is believed that the haplotype of any taste receptor can influence the perception of taste by a subject, it may sometimes be beneficial to determine whether a subject is homozygous or heterozygous for SNPs within any one or more of the T2R bitter taste receptors described herein.

By way of example, the oligonucleotide ligation assay (OLA), as described at Nickerson et al. (*Proc. Natl. Acad. Sci. USA* 87:8923-8927, 1990), allows the differentiation between individuals who are homozygous versus heterozygous for alleles or SNPs indicated in FIG. 1 or Table 7. This feature allows one to rapidly and easily determine whether an individual is homozygous for at least one taste receptor variant, which condition believed to influence taste perception, particularly bitter taste reception, in the individual. Alternatively, OLA can be used to determine whether a subject is homozygous for either of these mutations.

As an example of the OLA assay, when carried out in microtiter plates, one well is used for the determination of the presence of the T2R bitter taste allele in the T2R1 gene that contains an A at nucleotide position 332 (numbering from SEQ ID NO: 1) and a second well is used for the determination of the presence of the T2R bitter taste allele in the same gene that contains a G at that nucleotide position in the alternate allele sequence. Thus, the results for an individual who is heterozygous for the mutation will show a signal in each of the A and G wells.

Example 7

Bitter Taste Profiles

With the provision herein of specific SNPs within the family of bitter taste receptors that are linked to bitter taste sensitivity to one or more bitter compounds, as well as SNPs and haplotypes that can be used to distinguish populations from each other, genetic profiles that provide information on the bitter taste perception and/or regionality of a subject are now enabled. Such profiles are useful in myriad applications, including for instance selecting subjects for inclusion in (or exclusion from) a protocol (such as a taste test), Bitter taste-related genetic profiles comprise the distinct and identifiable pattern of alleles or haplotypes, or sets of alleles or haplotypes, of the SNPs in bitter taste receptor molecules identified herein. The set of bitter taste receptors analyzed in a particular profile will usually include at least one of the following: T2R1, T2R3, T2R4, T2R5, T2R7, T2R8, T2R9, T2R10, T2R13, T2R14, T2R16, T2R38, T2R39, T2 R40, T2R41, T2R43, T2R44, T2R45, T2R46, T2R47, T2R48, T2R49, T2R50, or T2R60.

By way of example, any subset of the molecules listed in FIG. 1 or Table 7 (or corresponding to the molecules in these lists) may be included in a single bitter taste profile. Specific examples of such subsets include those molecules that show a SNP that introduces a stop codon (e.g., the variant of T2R44 at position 843; the variant of T2R46 at position 749 or 86, or the variant of T2R48 at position 885); that show a novel SNP (e.g., those T2R genes with a "new" SNP indicated in FIG. 1); and so forth. Alternatively, gene profiles may be further broken down by the type of bitter taste receptors included in the profile, for instance, those which all occur on a single chromosome (e.g., CH 5, 7, or 12), or all of the haplotypes/isoforms of a single T2R gene. Specific contemplated subsets of sequences will include at least one of the following: two or more nucleotides selected from SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, and 263; or two or more polypeptides having a sequence selected from SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, and 264; or at least one fragment from each of two or more of such molecules, which fragment overlaps a variant defined in any one of SEQ ID NOs: 1-46.

The alleles/haplotypes of each bitter taste receptor included in a specific profile can be determined in any of various known ways, including specific methods provided herein. One particular contemplated method for detecting and determining the genotype and/or haplotype of multiple bitter taste receptors employs an array of allele-specific oligonucleotides which are used for qualitative and/or quantitative hybridization detection of the presence of specific alleles or SNPs in a sample from a subject.

Optionally, a subject's bitter taste profile can be correlated with one or more appropriate inhibitors or blockers of bitter taste, or other compounds that influence the ability of a subject to perceive a taste, which may be correlated with a control (or set of control) profile(s) condition linked to or associated with, for instance, sensitivity to one or a set of bitter compounds. Optionally, the subject's bitter taste profile can be correlated with one or more appropriate treatments, for instance, treatments with compounds that inhibit or enhance the activity of one or more of the bitter taste alleles identified in the profile, or compositions in which the bitter taste of a component is specifically masked by a blocker that is added based on the information in the profile.

Example 8

Expression of T2R Bitter Taste Receptor Variant Polypeptides

The expression and purification of proteins, such as a T2R bitter taste receptor variant protein, can be performed using standard laboratory techniques, though these techniques are preferentially adapted to be fitted to express the T2R proteins. By way of example, techniques for expression of T2R family proteins is discussed in Wu et al., *PNAS* 99:2392-2397, 2002 (incorporated herein by reference in its entirety).

Additional examples of such method adaptations are discussed or referenced herein. After expression, purified protein may be used for functional analyses, antibody production, diagnostics, and patient therapy. Furthermore, the DNA sequences of the T2R bitter taste receptor variant cDNAs can be manipulated in studies to understand the expression of the gene and the function of its product. Variant or allelic forms of a human T2R bitter taste receptor genes may be isolated based upon information contained herein, and may be studied in order to detect alteration in expression patterns in terms of relative quantities, tissue specificity and functional properties of the encoded T2R bitter taste receptor variant protein (e.g., influence on perception of taste). Partial or full-length cDNA sequences, which encode for the subject protein, may be ligated into bacterial expression vectors. Methods for expressing large amounts of protein from a cloned gene introduced into *Escherichia coli* (*E. coli*) or more preferably baculovirus/Sf9 cells may be utilized for the purification, localization and functional analysis of proteins. For example, fusion proteins consisting of amino terminal peptides encoded by a portion of a gene native to the cell in which the protein is expressed (e.g., a *E. coli* lacZ or trpE gene for bacterial expression) linked to a T2R bitter taste receptor variant protein may be used to prepare polyclonal and monoclonal antibodies against these proteins. Thereafter, these antibodies may be used to purify proteins by immunoaffinity chromatography, in diagnostic assays to quantitate the levels of protein and to localize proteins in tissues and individual cells by immunofluorescence.

Intact native protein may also be produced in large amounts for functional studies. Methods and plasmid vectors for producing fusion proteins and intact native proteins in culture are well known in the art, and specific methods are described in Sambrook et al. (In *Molecular Cloning: A Laboratory Manual*, Ch. 17, CSHL, New York, 1989). Such fusion proteins may be made in large amounts, are easy to purify, and can be used to elicit antibody response. Native proteins can be produced in bacteria by placing a strong, regulated promoter and an efficient ribosome-binding site upstream of the cloned gene. If low levels of protein are produced, additional steps may be taken to increase protein production; if high levels of protein are produced, purification is relatively easy. Suitable methods are presented in Sambrook et al. (In *Molecular Cloning: A Laboratory Manual*, CSHL, New York, 1989) and are well known in the art. Often, proteins expressed at high levels are found in insoluble inclusion bodies. Methods for extracting proteins from these aggregates are described by Sambrook et al. (In *Molecular Cloning: A Laboratory Manual*, Ch. 17, CSHL, New York, 1989). Vector systems suitable for the expression of lacZ fusion genes include the pUR series of vectors (Ruther and Muller-Hill, *EMBO J.* 2:1791, 1983), pEX1-3 (Stanley and Luzio, *EMBO J.* 3:1429, 1984) and pMR100 (Gray et al., *Proc. Natl. Acad. Sci. USA* 79:6598, 1982). Vectors suitable for the production of intact native proteins include pKC30 (Shimatake and Rosenberg, *Nature* 292:128, 1981), pKK177-3 (Amann and Brosius, *Gene* 40:183, 1985) and pET-3 (Studiar and Moffatt, *J. Mol. Biol.* 189:113, 1986).

Fusion proteins may be isolated from protein gels, lyophilized, ground into a powder and used as an antigen. The DNA sequence can also be transferred from its existing context to other cloning vehicles, such as other plasmids, bacteriophages, cosmids, animal viruses and yeast artificial chromosomes (YACs) (Burke et al., *Science* 236:806-812, 1987). These vectors may then be introduced into a variety of hosts including somatic cells, and simple or complex organisms, such as bacteria, fungi (Timberlake and Marshall, *Science* 244:1313-1317, 1989), invertebrates, plants (Gasser and Fraley, *Science* 244:1293, 1989), and animals (Pursel et al., *Science* 244:1281-1288, 1989), which cell or organisms are rendered transgenic by the introduction of the heterologous cDNA.

For expression in mammalian cells, the cDNA sequence may be ligated to heterologous promoters, such as the simian virus (SV) 40 promoter in the pSV2 vector (Mulligan and Berg, *Proc. Natl. Acad. Sci. USA* 78:2072-2076, 1981), and introduced into cells, such as monkey COS-1 cells (Gluzman, *Cell* 23:175-182, 1981), to achieve transient or long-term expression. The stable integration of the chimeric gene construct may be maintained in mammalian cells by biochemical selection, such as neomycin (Southern and Berg, *J. Mol. Appl. Genet.* 1:327-341, 1982) and mycophenolic acid (Mulligan and Berg, *Proc. Natl. Acad. Sci. USA* 78:2072-2076, 1981).

DNA sequences can be manipulated with standard procedures such as restriction enzyme digestion, fill-in with DNA polymerase, deletion by exonuclease, extension by terminal deoxynucleotide transferase, ligation of synthetic or cloned DNA sequences, site-directed sequence-alteration via single-stranded bacteriophage intermediate or with the use of specific oligonucleotides in combination with PCR or other in vitro amplification.

The cDNA sequence (or portions derived from it) or a mini gene (a cDNA with an intron and its own promoter) may be introduced into eukaryotic expression vectors by conventional techniques. These vectors are designed to permit the transcription of the cDNA in eukaryotic cells by providing regulatory sequences that initiate and enhance the transcription of the cDNA and ensure its proper splicing and polyadenylation. Vectors containing the promoter and enhancer regions of the SV40 or long terminal repeat (LTR) of the Rous Sarcoma virus and polyadenylation and splicing signal from SV40 are readily available (Mulligan et al., *Proc. Natl. Acad. Sci. USA* 78:1078-2076, 1981; Gorman et al., *Proc. Natl. Acad. Sci USA* 78:6777-6781, 1982). The level of expression of the cDNA can be manipulated with this type of vector, either by using promoters that have different activities (for example, the baculovirus pAC373 can express cDNAs at high levels in *S. frugiperda* cells (Summers and Smith, In *Genetically Altered Viruses and the Environment*, Fields et al. (Eds.) 22:319-328, CSHL Press, Cold Spring Harbor, N.Y., 1985) or by using vectors that contain promoters amenable to modulation, for example, the glucocorticoid-responsive promoter from the mouse mammary tumor virus (Lee et al., *Nature* 294:228, 1982). The expression of the cDNA can be monitored in the recipient cells 24 to 72 hours after introduction (transient expression).

In addition, some vectors contain selectable markers such as the gpt (Mulligan and Berg, *Proc. Natl. Acad. Sci. USA* 78:2072-2076, 1981) or neo (Southern and Berg, *J. Mol. Appl. Genet.* 1:327-341, 1982) bacterial genes. These selectable markers permit selection of transfected cells that exhibit stable, long-term expression of the vectors (and therefore the cDNA). The vectors can be maintained in the cells as episomal, freely replicating entities by using regulatory elements of viruses such as papilloma (Sarver et al., *Mol. Cell Biol.* 1:486, 1981) or Epstein-Barr (Sugden et al., *Mol. Cell Biol.* 5:410, 1985). Alternatively, one can also produce cell lines that have integrated the vector into genomic DNA. Both of these types of cell lines produce the gene product on a continuous basis. One can also produce cell lines that have amplified the number of copies of the vector (and therefore of the cDNA as well) to create cell lines that can produce high levels of the gene product (Alt et al., *J. Biol. Chem.* 253:1357, 1978).

The transfer of DNA into eukaryotic, in particular human or other mammalian cells, is now a conventional technique. The vectors are introduced into the recipient cells as pure DNA (transfection) by, for example, precipitation with calcium phosphate (Graham and vander Eb, *Virology* 52:466, 1973) or strontium phosphate (Brash et al., *Mol. Cell Biol.* 7:2013, 1987), electroporation (Neumann et al., *EMBO J* 1:841, 1982), lipofection (Felgner et al., *Proc. Natl. Acad. Sci USA* 84:7413, 1987), DEAE dextran (McCuthan et al., *J. Natl. Cancer Inst.* 41:351, 1968), microinjection (Mueller et al., *Cell* 15:579, 1978), protoplast fusion (Schafner, *Proc. Natl. Acad. Sci. USA* 77:2163-2167, 1980), or pellet guns (Klein et al., *Nature* 327:70, 1987). Alternatively, the cDNA, or fragments thereof, can be introduced by infection with virus vectors. Systems are developed that use, for example, retroviruses (Bernstein et al., *Gen. Engr'g* 7:235, 1985), adenoviruses (Ahmad et al., *J. Virol.* 57:267, 1986), or Herpes virus (Spaete et al., *Cell* 30:295, 1982). T2R encoding sequences can also be delivered to target cells in vitro via non-infectious systems, for instance liposomes.

These eukaryotic expression systems can be used for studies of T2R bitter taste receptor variant encoding nucleic acids and mutant forms of these molecules, T2R bitter taste receptor variant proteins and mutant forms of these proteins. The eukaryotic expression systems may also be used to study the function of the normal complete protein, specific portions of the protein, or of naturally occurring or artificially produced mutant proteins.

Using the above techniques, the expression vectors containing a T2R gene sequence or cDNA, or fragments or variants or mutants thereof, can be introduced into human cells, mammalian cells from other species or non-mammalian cells as desired. The choice of cell is determined by the purpose of the treatment. For example, monkey COS cells (Gluzman, *Cell* 23:175-182, 1981) that produce high levels of the SV40 T antigen and permit the replication of vectors containing the SV40 origin of replication may be used. Similarly, Chinese hamster ovary (CHO), mouse NIH 3T3 fibroblasts or human fibroblasts or lymphoblasts may be used.

The present disclosure thus encompasses recombinant vectors that comprise all or part of the T2R bitter taste receptor variant gene or cDNA sequences, for expression in a suitable host. The T2R bitter taste receptor DNA is operatively linked in the vector to an expression control sequence in the recombinant DNA molecule so that a T2R bitter taste receptor polypeptide can be expressed. The expression control sequence may be selected from the group consisting of sequences that control the expression of genes of prokaryotic or eukaryotic cells and their viruses and combinations thereof. The expression control sequence may be specifically selected from the group consisting of the lac system, the trp system, the tac system, the trc system, major operator and promoter regions of phage lambda, the control region of fd coat protein, the early and late promoters of SV40, promoters derived from polyoma, adenovirus, retrovirus, baculovirus and simian virus, the promoter for 3-phosphoglycerate kinase, the promoters of yeast acid phosphatase, the promoter of the yeast alpha-mating factors and combinations thereof.

One highly successful method of expressing T2R's to date is to engineer an amino-terminal portion of rhodopsin (e.g., the first 26 amino acids thereof) onto the amino terminal end and express the resultant fusion protein, for instance in a baculovirus/Sf9 cell system. By way of example, methods for expressing T2Rs in vitro are described in Chandrashekar et al. (*Cell* 100:703-711, 2000), which is incorporated herein by reference in its entirety. See also Vince et al., *PNAS* 99:2392-2397, 2002.

The host cell, which may be transfected with the vector of this disclosure, may be selected from the group consisting of *E. coli, Pseudomonas, Bacillus subtilis, Bacillus stearothermophilis* or other bacilli; other bacteria; yeast; fungi; insect; mouse or other animal; or plant hosts; or human tissue cells.

It is appreciated that for mutant or variant T2R bitter taste receptor DNA sequences, similar systems are employed to express and produce the mutant product. In addition, fragments of a T2R bitter taste receptor protein can be expressed essentially as detailed above. Such fragments include individual T2R bitter taste receptor protein domains or sub-domains, as well as shorter fragments such as peptides. T2R bitter taste receptor protein fragments having therapeutic properties may be expressed in this manner also, including for instance substantially soluble fragments.

Example 9

Production of Protein Specific Binding Agents

Monoclonal or polyclonal antibodies may be produced to either a wildtype or reference T2R bitter taste receptor protein or specific allelic forms of these proteins, for instance particular portions that contain a differential amino acid encoded by a SNP and therefore may provide a distinguishing epitope. Optimally, antibodies raised against these proteins or peptides would specifically detect the protein or peptide with which the antibodies are generated. That is, an antibody generated to the specified bitter taste receptor protein or a fragment thereof would recognize and bind that protein and would not substantially recognize or bind to other proteins found in human cells. In some embodiments, an antibody is specific for (or measurably preferentially binds to) an epitope in a variant protein (e.g., an allele of a T2R bitter taste receptor as described herein) versus the reference protein, or vice versa, as discussed more fully herein.

The determination that an antibody specifically detects a target protein or form of the target protein is made by any one of a number of standard immunoassay methods; for instance, the western blotting technique (Sambrook et al., In *Molecular Cloning: A Laboratory Manual*, CSHL, New York, 1989). To determine that a given antibody preparation (such as one produced in a mouse) specifically detects the target protein by western blotting, total cellular protein is extracted from human cells (for example, lymphocytes) and electrophoresed on a sodium dodecyl sulfate-polyacrylamide gel. The proteins are then transferred to a membrane (for example, nitrocellulose) by western blotting, and the antibody preparation is incubated with the membrane. After washing the membrane to remove non-specifically bound antibodies, the presence of specifically bound antibodies is detected by the use of an anti-mouse antibody conjugated to an enzyme such as alkaline phosphatase. Application of an alkaline phosphatase substrate 5-bromo-4-chloro-3-indolyl phosphate/nitro blue tetrazolium results in the production of a dense blue compound by immunolocalized alkaline phosphatase. Antibodies that specifically detect the target protein will, by this technique, be shown to bind to the target protein band (which will be localized at a given position on the gel determined by its molecular weight). Non-specific binding of the antibody to other proteins may occur and may be detectable as a weak signal on the Western blot. The non-specific nature of this binding will be recognized by one skilled in the art by the weak signal obtained on the Western blot relative to the strong primary signal arising from the specific antibody-target protein binding.

Substantially pure T2R bitter taste receptor protein or protein fragment (peptide) suitable for use as an immunogen may be isolated from the transfected or transformed cells as described above. Concentration of protein or peptide in the final preparation is adjusted, for example, by concentration on an Amicon filter device, to the level of a few micrograms per milliliter. Monoclonal or polyclonal antibody to the protein can then be prepared as follows:

A. Monoclonal Antibody Production by Hybridoma Fusion

Monoclonal antibody to epitopes of the target protein identified and isolated as described can be prepared from murine hybridomas according to the classical method of Kohler and Milstein (*Nature* 256:495-497, 1975) or derivative methods thereof. Briefly, a mouse is repetitively inoculated with a few micrograms of the selected protein over a period of a few weeks. The mouse is then sacrificed, and the antibody-producing cells of the spleen isolated. The spleen cells are fused by means of polyethylene glycol with mouse myeloma cells, and the excess un-fused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall (*Meth. Enzymol.* 70:419-439, 1980), and derivative methods thereof. Selected positive clones can be expanded and their monoclonal antibody product harvested for use. Detailed procedures for monoclonal antibody production are described in Harlow and Lane (*Antibodies, A Laboratory Manual*, CSHL, New York, 1988).

B. Polyclonal Antibody Production by Immunization

Polyclonal antiserum containing antibodies to heterogeneous epitopes of a single protein can be prepared by immunizing suitable animals with the expressed protein, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals vary in response to site of inoculations and dose, with either inadequate or excessive doses of antigen resulting in low titer antisera. Small doses (ng level) of antigen administered at multiple intradermal sites appear to be most reliable. An effective immunization protocol for rabbits can be found in Vaitukaitis et al. (*J. Clin. Endocrinol. Metab.* 33:988-991, 1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony et al. (In *Handbook of Experimental Immunology*, Wier, D. (ed.) chapter 19. Blackwell, 1973). Plateau concentration of antibody is usually in the range of about 0.1 to 0.2 mg/ml of serum (about 12 µM). Affinity of the antisera for the antigen is determined by preparing competitive binding curves, as described, for example, by Fisher (*Manual of Clinical Immunology*, Ch. 42, 1980).

C. Antibodies Raised Against Synthetic Peptides

A third approach to raising antibodies against a specific T2R bitter taste receptor protein or peptide (e.g., a peptide that is specific to a variant T2R bitter taste receptor such as those disclosed herein) is to use one or more synthetic peptides synthesized on a commercially available peptide synthesizer based upon the predicted amino acid sequence of the protein or peptide. Polyclonal antibodies can be generated by injecting these peptides into, for instance, rabbits or mice.

D. Antibodies Raised by Injection of Encoding Sequence

Antibodies may be raised against proteins and peptides by subcutaneous injection of a DNA vector that expresses the desired protein or peptide, or a fragment thereof, into laboratory animals, such as mice. Delivery of the recombinant vector into the animals may be achieved using a hand-held form of the Biolistic system (Sanford et al., *Particulate Sci. Technol.* 5:27-37, 1987) as described by Tang et al. (*Nature* 356: 152-154, 1992). Expression vectors suitable for this purpose may include those that express the T2R bitter taste receptor-encoding sequence under the transcriptional control of either the human β-actin promoter or the cytomegalovirus (CMV) promoter.

Antibody preparations prepared according to these protocols are useful in quantitative immunoassays which determine concentrations of antigen-bearing substances in biological samples; they are also used semi-quantitatively or qualitatively to identify the presence of antigen in a biological sample; or for immunolocalization of the specified protein.

Optionally, antibodies, e.g., bitter taste receptor-specific monoclonal antibodies, can be humanized by methods known in the art. Antibodies with a desired binding specificity can be commercially humanized (Scotgene, Scotland, UK; Oxford Molecular, Palo Alto, Calif.).

E. Antibodies Specific for Specific T2R Taste Receptor Variants

With the provision of several variant T2R bitter taste receptor proteins, the production of antibodies that specifically recognize these protein variants (and peptides derived therefrom) is enabled. In particular, production of antibodies (and fragments and engineered versions thereof) that recognize at least one variant receptor with a higher affinity than they recognize a corresponding wild type T2R bitter taste receptor, or another bitter taste receptor, is beneficial, as the resultant antibodies can be used in analysis, diagnosis and treatment (e.g., inhibition or enhancement of bitter taste perception), as well as in study and examination of the T2R bitter taste receptor proteins themselves.

In particular embodiments, it is beneficial to generate antibodies from a peptide taken from a variation-specific region of the desired T2R bitter taste receptor protein. By way of example, such regions include any peptide (usually four or more amino acids in length) that overlaps with one or more of the SNP-encoded variants described herein. More particularly, it is beneficial to raise antibodies against peptides of four or more contiguous amino acids that overlap the variants identified in SEQ ID NO: 2, 4, 6, 8, 10, 12, 14, 16, 18, 20, 22, 24, 26, 28, 30, 32, 34, 36, 40, 42, or 46, and particularly which comprise at least four contiguous amino acids including the residue(s) indicated in FIG. 1 or Table 7 to be variable in different alleles of the specified T2R putative bitter taste receptors/isoforms.

Longer peptides also can be used, and in some instances will produce a stronger or more reliable immunogenic response. Thus, it is contemplated in some embodiments that more than four amino acids are used to elicit the immune response, for instance, at least 5, at least 6, at least 8, at least 10, at least 12, at least 15, at least 18, at least 20, at least 25, or more, such as 30, 40, 50, or even longer peptides. Also, it will be understood by those of ordinary skill that it is beneficial in some instances to include adjuvants and other immune response enhancers, including passenger peptides or proteins, when using peptides to induce an immune response for production of antibodies.

Embodiments are not limited to antibodies that recognize epitopes containing the actual mutation identified in each variant. Instead, it is contemplated that variant-specific antibodies also may each recognize an epitope located anywhere throughout the specified T2R bitter taste receptor variant molecule, which epitopes are changed in conformation and/or availability because of the activating mutation. Antibodies directed to any of these variant-specific epitopes are also encompassed herein.

By way of example, the following references provide descriptions of methods for making antibodies specific to mutant proteins: Hills et al., (*Int. J. Cancer*, 63: 537-543, 1995); Reiter & Maihle (*Nucleic Acids Res.*, 24: 4050-4056, 1996); Okamoto et al. (*Br. J. Cancer*, 73: 1366-1372, 1996); Nakayashiki et al., (*Jpn. J. Cancer Res.*, 91: 1035-1043, 2000); Gannon et al. (*EMBO J.*, 9: 1595-1602, 1990); Wong et al. (*Cancer Res.*, 46: 6029-6033, 1986); and Carney et al. (*J. Cell Biochem.*, 32: 207-214, 1986). Similar methods can be employed to generate antibodies specific to specific T2R bitter taste receptor variants.

Example 10

Knockout and Overexpression Transgenic Animals

Mutant organisms that under-express or over-express one or more specific alleles (isoforms) of one or more specific bitter taste receptor protein are useful for research. Such mutants allow insight into the physiological and/or psychological role of bitter taste perception in a healthy and/or pathological organism. These "mutants" are "genetically engineered," meaning that information in the form of nucleotides has been transferred into the mutant's genome at a location, or in a combination, in which it would not normally exist. Nucleotides transferred in this way are said to be "non-native." For example, a non-bitter taste receptor promoter inserted upstream of a native bitter taste receptor-encoding sequence would be non-native. An extra copy of a specific bitter taste receptor gene on a plasmid, transformed into a cell, would be non-native.

Mutants may be, for example, produced from mammals, such as mice or rats, that either express, over-express, or under-express a specific allelic variant or haplotype or diplotype of a defined bitter taste receptor (or combination of bitter taste receptors), or that do not express a specified receptor (or combination of receptors) at all. Over-expression mutants are made by increasing the number of specified genes in the organism, or by introducing a specific taste receptor allele into the organism under the control of a constitutive or inducible or viral promoter such as the mouse mammary tumor virus (MMTV) promoter or the whey acidic protein (WAP) promoter or the metallothionein promoter. Mutants that under-express a taste receptor, or that do not express a specific allelic variant of a taste receptor, may be made by using an inducible or repressible promoter, or by deleting the taste receptor gene, or by destroying or limiting the function of the taste receptor gene, for instance by disrupting the gene by transposon insertion.

Antisense genes or molecules (such as siRNAs) may be engineered into the organism, under a constitutive or inducible promoter, to decrease or prevent expression of a specific T2R bitter taste receptor, as known to those of ordinary skill in the art.

A mutant mouse over-expressing a heterologous protein (such as a variant T2R bitter taste receptor protein) may be made by constructing a plasmid having a bitter taste receptor allele encoding sequence driven by a promoter, such as the mouse mammary tumor virus (MMTV) promoter or the whey acidic protein (WAP) promoter. This plasmid may be introduced into mouse oocytes by microinjection. The oocytes are implanted into pseudopregnant females, and the litters are assayed for insertion of the transgene. Multiple strains containing the transgene are then available for study.

WAP is quite specific for mammary gland expression during lactation, and MMTV is expressed in a variety of tissues including mammary gland, salivary gland and lymphoid tissues. Many other promoters might be used to achieve various patterns of expression, e.g., the metallothionein promoter.

An inducible system may be created in which the subject expression construct is driven by a promoter regulated by an agent that can be fed to the mouse, such as tetracycline. Such techniques are well known in the art.

A mutant knockout animal (e.g., mouse) from which a specific taste receptor gene is deleted can be made by removing all or some of the coding regions of the gene from embryonic stem cells. The methods of creating deletion mutations by using a targeting vector have been described (Thomas and Capecchi, *Cell* 51:503-512, 1987).

Example 11

Knock-In Organisms

In addition to knock-out systems, it is also beneficial to generate "knock-ins" that have lost expression of the native protein but have gained expression of a different, usually mutant or identified allelic form of the same protein. By way of example, any one or more of the allelic protein isoforms provided herein (e.g., as shown in SEQ ID NO: 2, 4, 6, 8, 10, 12, 14, 16, 18, 20, 22, 24, 26, 28, 30, 34, 36, 40, 42, and 46, or in SEQ ID NO: 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, and 264) can be expressed in a knockout background in order to provide model systems for studying the effects of these mutants. In particular embodiments, the resultant knock-in organisms provide systems for studying taste reception, for instance how the taste of specific molecules is perceived.

Those of ordinary skill in the relevant art know methods of producing knock-in organisms. See, for instance, Rane et al. (*Mol. Cell Biol.*, 22: 644-656, 2002); Sotillo et al. (*EMBO J.*, 20: 6637-6647, 2001); Luo et al. (*Oncogene*, 20: 320-328, 2001); Tomasson et al. (*Blood*, 93: 1707-1714, 1999); Voncken et al. (86: 4603-4611, 1995); Andrae et al. (*Mech. Dev.*, 107: 181-185, 2001); Reinertsen et al. (*Gene Expr.*, 6: 301-314, 1997); Huang et al. (*Mol. Med.*, 5: 129-137, 1999); Reichert et al. (*Blood*, 97: 1399-1403, 2001); and Huettner et al. (*Nat. Genet.*, 24: 57-60, 2000), by way of example.

Example 12

Screening Assays for Compounds that Modulate Taste Receptor Expression or Activity The following assays are designed to identify compounds that interact with (e.g., bind to) a variant form of a T2R bitter taste receptor (including, but not limited to an ECD or a CD or a TMD of a variant T2R bitter taste receptor), compounds that interact with (e.g., bind to) intracellular proteins that interact with a variant form of a T2R bitter taste receptor (including, but not limited to, a TMD or a CD of a variant form of a T2R bitter taste receptor), compounds that interfere with the interaction of a taste receptor with transmembrane or intracellular proteins involved in taste receptor-mediated signal transduction, and to compounds which modulate the activity of a taste receptor gene (i.e., modulate the level of gene expression) or modulate the level of taste receptor activity of a variant form of a T2R bitter taste receptor. Assays may additionally be utilized which identify compounds which bind to taste receptor gene regulatory sequences (e.g., promoter sequences) and which may modulate taste receptor gene expression. See, e.g., Platt, *J Biol Chem* 269:28558-28562, 1994.

The compounds which may be screened in accordance with the invention include, but are not limited to peptides, antibodies and fragments thereof, and other organic compounds (e.g., peptidomimetics, small molecules) that bind to one or more ECDs of a variant T2R bitter taste receptor as described herein and either mimic the activity triggered by the natural ligand (i.e., agonists) or inhibit the activity triggered by the natural ligand (i.e., antagonists); as well as peptides, antibodies or fragments thereof, and other organic compounds that mimic the ECD of a variant T2R bitter taste receptor (or a portion thereof) and bind to and "neutralize" natural ligand.

Such compounds may include, but are not limited to, peptides such as, for example, soluble peptides, including but not limited to members of random peptide libraries; (see, e.g., Lam et al., *Nature* 354:82-84, 1991; Houghten et al., *Nature* 354:84-86, 1991), and combinatorial chemistry-derived molecular library made of D- and/or L-configuration amino acids, phosphopeptides (including, but not limited to, members of random or partially degenerate, directed phosphopeptide libraries; see, e.g., Songyang et al., *Cell* 72:767-778, 1993), antibodies (including, but not limited to, polyclonal, monoclonal, humanized, anti-idiotypic, chimeric or single chain antibodies, and Fab, F(ab')$_2$ and Fab expression library fragments, and epitope-binding fragments thereof), and small organic or inorganic molecules.

Other compounds which can be screened in accordance with the invention include but are not limited to small organic molecules that are able to gain entry into an appropriate cell and affect the expression of a variant T2R bitter taste receptor gene or some other gene involved in a taste receptor signal transduction pathway (e.g., by interacting with the regulatory region or transcription factors involved in gene expression); or such compounds that affect the activity of a variant T2R bitter taste receptor or the activity of some other intracellular factor involved in the taste receptor signal transduction pathway.

Computer modeling and searching technologies permit identification of compounds, or the improvement of already identified compounds, that can modulate expression or activity of a variant T2R bitter taste receptor. Having identified such a compound or composition, the active sites or regions are identified. Such active sites might typically be ligand binding sites, such as the interaction domains of a bitter molecule with a variant T2R bitter taste receptor itself, or the interaction domains of a bitter molecule with a specific allelic variant T2R bitter taste receptor isoform in comparison to the interaction domains of that molecule with another isoform of the same or a different T2R bitter taste receptor (to reproduce the effect of an amino acid substitution such as the alanine substitution in the PTC gene (T2R38) for designing bitter taste blockers, or to reproduce the effect of the proline substitution in the PTC gene for designing bitter taste mimics).

The active site can be identified using methods known in the art including, for example, from the amino acid sequences of peptides, from the nucleotide sequences of nucleic acids, or from study of complexes of the relevant compound or composition with its natural ligand. In the latter case, chemical methods can be used to find the active site by finding where on the factor the complexed ligand is found. Next, the three dimensional geometric structure of the active site is determined. This can be done by known methods can determine a complete molecular structure. On the other hand, solid or liquid phase NMR can be used to determine certain intramolecular distances. Any other experimental method of structure determination can be used to obtain partial or complete geometric structures, such as high resolution electron microscopy. The geometric structures may be measured with a complexed ligand, natural or artificial, which may increase the accuracy of the active site structure determined. In another embodiment, the structure of the specified taste receptor is compared to that of a "variant" of the specified taste receptor and, rather than solve the entire structure, the structure is solved for the protein domains that are changed.

If an incomplete or insufficiently accurate structure is determined, the methods of computer based numerical modeling can be used to complete the structure or improve its accuracy. Any recognized modeling method may be used, including parameterized models specific to particular biopolymers such as proteins or nucleic acids, molecular dynamics models based on computing molecular motions, statistical mechanics models based on thermal ensembles, or combined models. For most types of models, standard molecular force fields, representing the forces between constituent atoms and groups, are necessary, and can be selected from force fields known in physical chemistry. The incomplete or less accurate experimental structures can serve as constraints on the complete and more accurate structures computed by these modeling methods.

Finally, having determined the structure of the active site, either experimentally, by modeling, or by a combination, candidate modulating compounds can be identified by searching databases containing compounds along with information on their molecular structure. Such a search seeks compounds having structures that match the determined active site structure and that interact with the groups defining the active site. Such a search can be manual, but is preferably computer assisted. These compounds found from this search are potential variant T2R bitter taste receptor modulating compounds.

Alternatively, these methods can be used to identify improved modulating compounds from an already known modulating compound or ligand. The composition of the known compound can be modified and the structural effects of modification can be determined using the experimental and computer modeling methods described above applied to the new composition. The altered structure is then compared to the active site structure of the compound to determine if an improved fit or interaction results. In this manner systematic variations in composition, such as by varying side groups, can be quickly evaluated to obtain modified modulating compounds or ligands of improved specificity or activity.

In another embodiment, the structure of a specified allelic taste receptor (the reference form) is compared to that of a variant taste receptor (encoded by a different allele of the same specified receptor). Then, potential bitter taste inhibitors are designed that bring about a structural change in the reference form so that it resembles the variant form. Or, potential bitter taste mimics are designed that bring about a structural change in the variant form so that it resembles another variant form, or the form of the reference receptor.

Further experimental and computer modeling methods useful to identify modulating compounds based upon identification of the active sites of bitter compounds, various variants of the T2R bitter taste receptors described herein, and related transduction and transcription factors will be apparent to those of skill in the art.

Examples of molecular modeling systems are the CHARMM and QUANTA programs (Polygen Corporation, Waltham, Mass.). CHARMm performs the energy minimization and molecular dynamics functions. QUANTA performs the construction, graphic modeling and analysis of molecular structure. QUANTA allows interactive construction, modification, visualization, and analysis of the behavior of molecules with each other.

A number of articles review computer modeling of drugs interactive with specific-proteins, such as Rotivinen et al. *Acta Pharmaceutical Fennica* 97:159-166, 1988; Ripka, *New Scientist* 54-57, 1988; McKinaly and Rossmann, *Annu Rev Pharmacol Toxicol* 29:111-122, 1989; Perry and Davies, *OSAR: Quantitative Structure-Activity Relationships in Drug Design* pp. 189-193, 1989 (Alan R. Liss, Inc.); Lewis and Dean, *Proc R Soc Lond* 236:125-140 and 141-162, 1989; and, with respect to a model receptor for nucleic acid components, Askew et al., *J Am Chem Soc* 111: 1082-1090, 1989. Other computer programs that screen and graphically depict chemicals are available from companies such as BioDesign, Inc. (Pasadena, Calif.), Allelix, Inc. (Mississauga, Ontario, Canada), and Hypercube, Inc. (Cambridge, Ontario). Although these are primarily designed for application to drugs specific to particular proteins, they can be adapted to design of drugs specific to regions of DNA or RNA, once that region is identified.

Although described above with reference to design and generation of compounds which could alter binding, one could also screen libraries of known compounds, including natural products or synthetic chemicals, and biologically active materials, including proteins, for compounds which are inhibitors or activators.

Compounds identified via assays such as those described herein may be useful, for example, in elaborating the biological function of a variant T2R bitter taste receptor gene product, and for designing bitter taste blockers and mimics.

Example 13

In Vitro Screening Assays for Compounds that Bind to a Variant T2R Taste Receptor In vitro systems may be designed to identify compounds capable of interacting with (e.g., binding to) a variant T2R bitter taste receptor (including, but not limited to, an ECD, or a TMD, or a CD of a variant T2R bitter taste receptor). Compounds identified may be useful, for example, in modulating the activity of "wild type" and/or "variant" T2R bitter taste receptor gene products; may be useful in elaborating the biological function of taste receptors; may be utilized in screens for identifying compounds that disrupt normal T2R bitter taste receptor interactions; or may in themselves disrupt such interactions.

The principle of assays used to identify compounds that bind to a variant T2R bitter taste receptor involves preparing a reaction mixture of a variant T2R bitter taste receptor polypeptide and a test compound under conditions and for a time sufficient to allow the two components to interact and bind, thus forming a complex which can be removed and/or detected in the reaction mixture. The variant T2R bitter taste receptor species used can vary depending upon the goal of the screening assay. For example, where agonists or antagonists are sought, the full length variant T2R bitter taste receptor, or a soluble truncated taste receptor, e.g., in which a TMD and/or a CD is deleted from the molecule, a peptide corresponding to an ECD or a fusion protein containing a variant T2R bitter taste receptor ECD fused to a protein or polypeptide that affords advantages in the assay system (e.g., labeling, isolation of the resulting complex, etc.) can be utilized. Where compounds that interact with the cytoplasmic domain are sought to be identified, peptides corresponding to a variant T2R bitter taste receptor CD and fusion proteins containing a variant T2R bitter taste receptor CD can be used.

The screening assays can be conducted in a variety of ways. For example, one method to conduct such an assay would involve anchoring the variant T2R bitter taste receptor protein, polypeptide, peptide or fusion protein or the test substance onto a solid phase and detecting taste receptor/test compound complexes anchored on the solid phase at the end of the reaction. In one embodiment of such a method, the taste receptor reactant may be anchored onto a solid surface, and the test compound, which is not anchored, may be labeled, either directly or indirectly.

In practice, microtiter plates may conveniently be utilized as the solid phase. The anchored component may be immobilized by non-covalent or covalent attachments. Non-covalent attachment may be accomplished by simply coating the solid surface with a solution of the protein and drying. Alternatively, an immobilized antibody, preferably a monoclonal antibody, specific for the protein to be immobilized may be used to anchor the protein to the solid surface. The surfaces may be prepared in advance and stored.

In order to conduct the assay, the nonimmobilized component is added to the coated surface containing the anchored component. After the reaction is complete, unreacted components are removed (e.g., by washing) under conditions such that any complexes formed will remain immobilized on the solid surface. The detection of complexes anchored on the solid surface can be accomplished in a number of ways. Where the previously nonimmobilized component is pre-labeled, the detection of label immobilized on the surface indicates that complexes were formed. Where the previously nonimmobilized component is not pre-labeled, an indirect label can be used to detect complexes anchored on the surface; e.g., using a labeled antibody specific for the previously nonimmobilized component (the antibody, in turn, may be directly labeled or indirectly labeled with a labeled anti-Ig antibody).

Alternatively, a reaction can be conducted in a liquid phase, the reaction products separated from unreacted components, and complexes detected; e.g., using an immobilized antibody specific for a variant T2R bitter taste receptor protein, polypeptide, peptide or fusion protein or the test compound to anchor any complexes formed in solution, and a labeled antibody specific for the other component of the possible complex to detect anchored complexes.

Alternatively, cell-based assays, membrane vesicle-based assays and membrane fraction-based assays can be used to identify compounds that interact with a variant T2R bitter taste receptor. To this end, cell lines that express a variant T2R bitter taste receptor (or combination thereof) or cell lines (e.g., COS cells, CHO cells, HEK293 cells, etc.) have been genetically engineered to express variant T2R bitter taste receptor (e.g., by transfection or transduction of taste receptor DNA) can be used. Interaction of the test compound with, for example, an ECD or a CD of a variant T2R bitter taste receptor expressed by the host cell can be determined by comparison or competition with a bitter compound or analog thereof, such as PTC.

A variant T2R bitter taste receptor polypeptide (such as those described herein) may be employed in a screening process for compounds which bind the receptor and which activate (agonists) or inhibit activation (antagonists) of the receptor polypeptide of the present invention. Thus, polypeptides described herein may also be used to assess the binding of small molecule substrates and ligands in, for example, cells, cell-free preparations, chemical libraries, and natural product mixtures. These substrates and ligands may be natural substrates and ligands or may be structural or functional mimetics. See Coligan et al. *Current Protocols in Immunology* 1 (2): Chapter 5, 1991.

In general, such screening procedures involve providing appropriate cells which express a receptor polypeptide of the present invention on the surface thereof. Such cells include cells from mammals, insects, yeast, and bacteria. In particular, a polynucleotide encoding the receptor of the present invention is employed to transfect cells to thereby express a variant T2R bitter taste receptor. The expressed receptor is then contacted with a test compound to observe binding, stimulation or inhibition of a functional response.

One such screening procedure involves the use of melanophores that are transfected to express a variant T2R bitter taste receptor. Such a screening technique is described in PCT WO 92/01810, published Feb. 6, 1992, and incorporated herein by reference. Such an assay may be employed to screen for a compound which inhibits activation of a receptor of the present invention by contacting the melanophore cells which encode the receptor with both a receptor ligand, such as PTC or another bitter compound, and a compound to be screened. Inhibition of the signal generated by the ligand indicates that a compound is a potential antagonist for the receptor, i.e., inhibits activation of the receptor.

The technique may also be employed for screening of compounds which activate a receptor of the present invention by contacting such cells with compounds to be screened and determining whether such compound generates a signal, i.e., activates the receptor.

Other screening techniques include the use of cells which express a variant T2R bitter taste receptor (for example, transfected CHO cells) in a system which measures extracellular pH changes caused by receptor activation. In this technique, compounds may be contacted with cells expressing a receptor polypeptide of the present invention. A second messenger response, e.g., signal transduction or pH changes, is then measured to determine whether the potential compound activates or inhibits the receptor.

Another screening technique involves expressing a variant T2R bitter taste receptor in which the receptor is linked to phospholipase C or D. Representative examples of such cells include, but are not limited to, endothelial cells, smooth muscle cells, and embryonic kidney cells. The screening may be accomplished as hereinabove described by detecting activation of the receptor or inhibition of activation of the receptor from the phospholipase second signal.

Another method involves screening for compounds which are antagonists, and thus inhibit activation of a receptor polypeptide of the present invention by determining inhibition of binding of labeled ligand, such as PTC or another bitter compound, to cells which have the receptor on the surface thereof, or cell membranes containing the receptor. Such a method involves transfecting a eukaryotic cell with a DNA encoding a variant T2R bitter taste receptor such that the cell expresses the receptor on its surface, or using of eukaryotic cells that express the receptor of the present invention on their surface (or using a eukaryotic cell that expresses the receptor on its surface). The cell is then contacted with a potential antagonist in the presence of a labeled form of a ligand, such as PTC or another bitter compound. The ligand can be labeled, e.g., by radioactivity. The amount of labeled ligand bound to the receptors is measured, e.g., by measuring radioactivity associated with transfected cells or membrane from these cells. If the compound binds to the receptor, the binding of labeled ligand to the receptor is inhibited as determined by a reduction of labeled ligand that binds to the receptors. This method is called a binding assay.

Another such screening procedure involves the use of eukaryotic cells, which are transfected to express the receptor of the present invention, or use of eukaryotic cells that express the receptor of the present invention on their surface. The cells are loaded with an indicator dye that produces a fluorescent signal when bound to calcium, and the cells are contacted with a test substance and a receptor agonist, such as PTC or another bitter compound. Any change in fluorescent signal is measured over a defined period of time using, for example, a fluorescence spectrophotometer or a fluorescence imaging plate reader. A change in the fluorescence signal pattern generated by the ligand indicates that a compound is a potential antagonist (or agonist) for the receptor.

Another such screening procedure involves use of eukaryotic cells, which are transfected to express the receptor of the present invention (or use of eukaryotic cells that express the receptor of the present invention), and which are also transfected with a reporter gene construct that is coupled to activation of the receptor (for example, luciferase or beta-galactosidase behind an appropriate promoter). The cells are contacted with a test substance and a receptor agonist, such as PTC or another bitter compound, and the signal produced by the reporter gene is measured after a defined period of time. The signal can be measured using a luminometer, spectrophotometer, fluorimeter, or other such instrument appropriate for the specific reporter construct used. Inhibition of the signal generated by the ligand indicates that a compound is a potential antagonist for the receptor.

Another such screening technique for antagonists or agonists involves introducing RNA encoding a PTC taste receptor into *Xenopus oocytes* to transiently express the receptor. The receptor expressing oocytes are then contacted with a receptor ligand, such as PTC, and a compound to be screened. Inhibition or activation of the receptor is then determined by detection of a signal, such as, cAMP, calcium, proton, or other ions.

Another such technique of screening for antagonists or agonists involves determining inhibition or stimulation of T2R taste receptor-mediated cAMP and/or adenylate cyclase accumulation or diminution. Such a method involves transiently or stably transfecting a eukaryotic cell with a variant T2R bitter taste receptor to express the receptor on the cell surface (or using a eukaryotic cell that expresses the receptor of the present invention on its surface). The cell is then exposed to potential antagonists in the presence of ligand, such as PTC or another bitter compound. The amount of cAMP accumulation is then measured, for example, by radioimmuno or protein binding assays (for example using Flashplates or a scintillation proximity assay). Changes in cAMP levels can also be determined by directly measuring the activity of the enzyme, adenylyl cyclase, in broken cell preparations. If the potential antagonist binds the receptor, and thus inhibits taste receptor binding, the levels of variant T2R bitter taste receptor-mediated cAMP, or adenylate cyclase activity, will be reduced or increased. Additional techniques for examining the activity of G-protein receptor pathways, and components therein, are known to those of ordinary skill in the art.

Example 14

Assays for Intracellular Proteins that Interact with a Variant T2R Bitter Taste Receptor Any method suitable for detecting protein-protein interactions may be employed for identifying transmembrane proteins or intracellular proteins that interact with a variant T2R bitter taste receptor. Among the traditional methods which may be employed are co-immunoprecipitation, crosslinking and co-purification through gradients or chromatographic columns of cell lysates or proteins obtained from cell lysates and a variant T2R bitter taste receptor to identify proteins in the lysate that interact with the PTC taste receptor. For these assays, a variant T2R bitter taste receptor component used can be a full length taste receptor, a soluble derivative lacking the membrane-anchoring region (e.g., a truncated taste receptor in which all TMDs are deleted resulting in a truncated molecule containing ECDs fused to CDs), a peptide corresponding to a CD or a fusion protein containing a CD of PTC taste receptor.

Once isolated, such an intracellular protein can be identified and can, in turn, be used, in conjunction with standard techniques, to identify proteins with which it interacts. For example, at least a portion of the amino acid sequence of an intracellular protein which interacts with the variant T2R bitter taste receptor can be ascertained using techniques well known to those of skill in the art, such as via the Edman degradation technique. See, e.g., Creighton *Proteins: Structures and Molecular Principles*, W.H. Freeman & Co., N.Y., pp. 34-49, 1983. The amino acid sequence obtained may be used as a guide for the generation of oligonucleotide mixtures that can be used to screen for gene sequences encoding such intracellular proteins. Screening may be accomplished, for example, by standard hybridization or PCR techniques. Techniques for the generation of oligonucleotide mixtures and the screening are well known. See, e.g., Ausubel et al. *Current Protocols in Molecular Biology* Green Publishing Associates and Wiley Interscience, N.Y., 1989; and Innis et al., eds. *PCR Protocols: A Guide to Methods and Applications* Academic Press, Inc., New York, 1990.

Additionally, methods may be employed which result in the simultaneous identification of genes, which encode the transmembrane or intracellular proteins interacting with a variant T2R bitter taste receptor. These methods include, for example, probing expression libraries, in a manner similar to the well known technique of antibody probing of λgt11 libraries, using labeled PTC taste receptor protein, or a variant T2R bitter taste receptor polypeptide, peptide or fusion protein, e.g., a variant T2R bitter taste receptor polypeptide or PTC taste receptor domain fused to a marker (e.g., an enzyme, fluor, luminescent protein, or dye), or an Ig-Fc domain.

One method that detects protein interactions in vivo, the two-hybrid system, is described in detail for illustration only and not by way of limitation. One version of this system has been described (Chien et al., *PNAS USA* 88:9578-9582, 1991) and is commercially available from Clontech (Palo Alto, Calif.).

Briefly, utilizing such a system, plasmids are constructed that encode two hybrid proteins: one plasmid consists of nucleotides encoding the DNA-binding domain of a transcription activator protein fused to a variant T2R bitter taste receptor nucleotide sequence encoding a variant T2R bitter taste receptor, a variant T2R bitter taste receptor polypeptide, peptide or fusion protein, and the other plasmid consists of nucleotides encoding the transcription activator protein's activation domain fused to a cDNA encoding an unknown protein which has been recombined into this plasmid as part of a cDNA library. The DNA-binding domain fusion plasmid and the cDNA library are transformed into a strain of the yeast *Saccharomyces cerevisiae* that contains a reporter gene (e.g., HBS or lacZ) whose regulatory region contains the transcription activator's binding site. Either hybrid protein alone cannot activate transcription of the reporter gene: the DNA-binding domain hybrid cannot because it does not provide activation function and the activation domain hybrid cannot because it cannot localize to the activator's binding sites. Interaction of the two hybrid proteins reconstitutes the functional activator protein and results in expression of the reporter gene, which is detected by an assay for the reporter gene product.

The two-hybrid system or related methodology may be used to screen activation domain libraries for proteins that interact with the "bait" gene product. By way of example, and not by way of limitation, PTC taste receptor may be used as the bait gene product. Total genomic or cDNA sequences are fused to the DNA encoding an activation domain. This library and a plasmid encoding a hybrid of a bait variant T2R bitter taste receptor gene product fused to the DNA-binding domain are cotransformed into a yeast reporter strain, and the resulting transformants are screened for those that express the reporter gene. For example, and not by way of limitation, a bait variant T2R bitter taste receptor gene sequence, such as the open reading frame of variant T2R bitter taste receptor (or a domain of a taste receptor) can be cloned into a vector such that it is translationally fused to the DNA encoding the DNA-binding domain of the GAL4 protein. These colonies are purified and the library plasmids responsible for reporter gene expression are isolated. DNA sequencing is then used to identify the proteins encoded by the library plasmids.

A cDNA library of the cell line from which proteins that interact with bait variant T2R bitter taste receptor gene product are to be detected can be made using methods routinely practiced in the art. According to the particular system described herein, for example, the cDNA fragments can be inserted into a vector such that they are translationally fused to the transcriptional activation domain of GAL4. This library can be co-transformed along with the bait PTC taste receptor gene-GAL4 fusion plasmid into a yeast strain, which contains a lacZ gene driven by a promoter that contains GAL4 activation sequence. A cDNA encoded protein, fused to GAL4 transcriptional activation domain, that interacts with bait PTC taste receptor gene product will reconstitute an active GAL4 protein and thereby drive expression of the HIS3 gene. Colonies, which express HIS3, can be detected by their growth on Petri dishes containing semi-solid agar based media lacking histidine. The cDNA can then be purified from these strains, and used to produce and isolate the bait PTC taste receptor gene-interacting protein using techniques routinely practiced in the art.

Example 15

Assays for Compounds that Interfere with Taste Receptor/Intracellular or Taste Receptor/Transmembrane Macromolecule Interaction The macromolecules that interact with a variant T2R bitter taste receptor are referred to, for purposes of this discussion, as "binding partners". These binding partners are likely to be involved in a variant T2R bitter taste receptor signal transduction pathway, and therefore, in the role of taste receptors and taste receptor variants in bitter tasting. Therefore, it is desirable to identify compounds that interfere with or disrupt the interaction of such binding partners with variant and/or normal T2R bitter taste receptor, which may be useful in regulating the activity of variant T2R bitter taste receptors and control the sensitivity to bitter tastes associated with certain taste receptor activity.

The basic principle of the assay systems used to identify compounds that interfere with the interaction between a variant T2R bitter taste receptor and its binding partner or partners involves preparing a reaction mixture containing variant T2R bitter taste receptor protein, polypeptide, peptide or fusion protein as described above, and the binding partner under conditions and for a time sufficient to allow the two to interact and bind, thus forming a complex. In order to test a compound for inhibitory activity, the reaction mixture is prepared in the presence and absence of the test compound. The test compound may be initially included in the reaction mixture, or may be added at a time subsequent to the addition of a variant T2R bitter taste receptor moiety and its binding partner. Control reaction mixtures are incubated without the test compound or with a placebo. The formation of any complexes between a variant T2R bitter taste receptor moiety and the binding partner is then detected. The formation of a complex in the control reaction, but not in the reaction mixture containing the test compound, indicates that the compound interferes with the interaction of a variant T2R bitter taste receptor and the binding partner. Additionally, complex formation within reaction mixtures containing the test compound and reference T2R bitter taste receptor variant may also be compared to complex formation within reaction mixtures containing the test compound and a different allelic or other variant of the same T2R taste receptor. This comparison may be important in those cases wherein it is desirable to identify compounds that disrupt interactions of reference but not variant T2R taste receptors, or differentially disrupt interactions between different variant T2R taste receptors.

The assay for compounds that interfere with the interaction of a variant T2R bitter taste receptor and binding partners can be conducted in a heterogeneous or homogeneous format. Heterogeneous assays involve anchoring either a variant T2R bitter taste receptor moiety product or the binding partner onto a solid phase and detecting complexes anchored on the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction by competition can be identified by conducting the reaction in the presence of the test substance; i.e., by adding the test substance to the reaction mixture prior to or simultaneously with a variant T2R bitter taste receptor moiety and interactive binding partner. Alternatively, test compounds that disrupt preformed complexes, e.g., compounds with higher binding constants that displace one of the components from the complex, can be tested by adding the test compound to the reaction mixture after complexes have been formed. The various formats are described briefly below.

In a heterogeneous assay system, either a variant T2R bitter taste receptor moiety or the interactive binding partner, is anchored onto a solid surface, while the non-anchored species is labeled, either directly or indirectly. In practice, microtiter plates are conveniently utilized. The anchored species may be immobilized by non-covalent or covalent attachments. Non-covalent attachment may be accomplished simply by coating the solid surface with a solution of a variant T2R bitter taste receptor gene product or binding partner and drying. Alternatively, an immobilized antibody specific for the species to be anchored may be used to anchor the species to the solid surface. The surfaces may be prepared in advance and stored.

In order to conduct the assay, the partner of the immobilized species is exposed to the coated surface with or without the test compound. After the reaction is complete, unreacted components are removed (e.g., by washing) and any complexes formed will remain immobilized on the solid surface. The detection of complexes anchored on the solid surface can be accomplished in a number of ways. Where the non-immobilized species is pre-labeled, the detection of label immobilized on the surface indicates that complexes were formed. Where the non-immobilized species is not pre-labeled, an indirect label can be used to detect complexes anchored on the surface; e.g., using a labeled antibody specific for the initially non-immobilized species (the antibody, in turn, may be directly labeled or indirectly labeled with a labeled anti-Ig antibody). Depending upon the order of addition of reaction components, test compounds which inhibit complex formation or which disrupt preformed complexes can be detected.

Alternatively, the reaction can be conducted in a liquid phase in the presence or absence of the test compound, the reaction products separated from unreacted components, and complexes detected; e.g., using an immobilized antibody specific for one of the binding components to anchor any complexes formed in solution, and a labeled antibody specific for the other partner to detect anchored complexes. Again, depending upon the order of addition of reactants to the liquid phase, test compounds which inhibit complex or which disrupt preformed complexes can be identified.

In an alternate embodiment of the invention, a homogeneous assay can be used. In this approach, a preformed complex of a variant T2R bitter taste receptor moiety and the interactive binding partner is prepared in which either a variant T2R bitter taste receptor or its binding partners is labeled, but the signal generated by the label is quenched due to formation of the complex (see, e.g., U.S. Pat. No. 4,109,496 by Rubenstein, which utilizes this approach for immunoassays). The addition of a test substance that competes with and displaces one of the species from the preformed complex will result in the generation of a signal above background. In this way, test substances, which disrupt PTC taste receptor/intracellular binding partner interaction can be identified.

In a particular embodiment, a variant T2R bitter taste receptor fusion can be prepared for immobilization. For example, a variant T2R bitter taste receptor or a peptide fragment, e.g., corresponding to a CD, can be fused to a glutathione-S-transferase (GST) gene using a fusion vector, such as pGEX-5X-1, in such a manner that its binding activity is maintained in the resulting fusion protein. The interactive binding partner can be purified and used to raise a monoclonal antibody, using methods routinely practiced in the art and described above. This antibody can be labeled with the radioactive isotope $^{125}$I, for example, by methods routinely practiced in the art. In a heterogeneous assay, e.g., the GST-taste receptor fusion protein can be anchored to glutathione-agarose beads. The interactive binding partner can then be added in the presence or absence of the test compound in a manner that allows interaction and binding to occur. At the end of the reaction period, unbound material can be washed away, and the labeled monoclonal antibody can be added to the system and allowed to bind to the complexed components. The interaction between a variant T2R bitter taste receptor gene product and the interactive binding partner can be detected by measuring the amount of radioactivity that remains associated with the glutathione-agarose beads. A successful inhibition of the interaction by the test compound will result in a decrease in measured radioactivity.

Alternatively, the GST-taste receptor fusion protein and the interactive binding partner can be mixed together in liquid in the absence of the solid glutathione-agarose beads. The test compound can be added either during or after the species are allowed to interact. This mixture can then be added to the glutathione-agarose beads and unbound material is washed away. Again the extent of inhibition of a variant T2R bitter taste receptor/binding partner interaction can be detected by adding the labeled antibody and measuring the radioactivity associated with the beads.

In another embodiment, these same techniques can be employed using peptide fragments that correspond to the binding domains of a variant T2R bitter taste receptor and/or the interactive or binding partner (in cases where the binding partner is a protein), in place of one or both of the full length proteins. Any number of methods routinely practiced in the art can be used to identify and isolate the binding sites. These methods include, but are not limited to, mutagenesis of the gene encoding one of the proteins and screening for disruption of binding in a co-immunoprecipitation assay. Compensating mutations in the gene encoding the second species in the complex can then be selected. Sequence analysis of the genes encoding the respective proteins will reveal the mutations that correspond to the region of the protein involved in interactive binding. Alternatively, one protein can be anchored to a solid surface using methods described above, and allowed to interact with and bind to its labeled binding partner, which has been treated with a proteolytic enzyme, such as trypsin. After washing, a short, labeled peptide comprising the binding domain may remain associated with the solid material, which can be isolated and identified by amino acid sequencing. Also, once the gene coding for the intracellular binding partner is obtained, short gene segments can be engineered to express peptide fragments of the protein, which can then be tested for binding activity and purified or synthesized.

For example, and not by way of limitation, a variant T2R bitter taste receptor gene product can be anchored to a solid material as described, above, by making a GST-taste receptor fusion protein and allowing it to bind to glutathione agarose beads. The interactive binding partner can be labeled with a radioactive isotope, such as $^{35}S$, and cleaved with a proteolytic enzyme such as trypsin. Cleavage products can then be added to the anchored GST-taste receptor fusion protein and allowed to bind. After washing away unbound peptides, labeled bound material, representing the intracellular binding partner binding domain, can be eluted, purified, and analyzed for amino acid sequence by well-known methods. Peptides so identified can be produced synthetically or fused to appropriate facilitative proteins using recombinant DNA technology.

Example 16

Assays for Identification of Compounds that Modulate Bitter Tastes

Compounds, including but not limited to compounds identified via assay techniques such as those described above, can be tested for the ability to modulate bitter tastes. The assays described above can identify compounds that affect variant T2R bitter taste receptor activity (e.g., compounds that bind to a variant T2R bitter taste receptor, inhibit binding of the natural ligand, and either activate signal transduction (agonists) or block activation (antagonists), and compounds that bind to a ligand of a variant T2R bitter taste receptor and neutralize ligand activity); or compounds that affect variant T2R bitter taste receptor gene activity (by affecting T2R bitter taste receptor gene expression, including molecules, e.g., proteins or small organic molecules, that affect or interfere with events so that expression of the full length variant or wild-type T2R bitter taste receptor can be modulated). However, it should be noted that the assays described can also identify compounds that modulate variant T2R bitter taste receptor signal transduction (e.g., compounds which affect downstream signaling events, such as inhibitors or enhancers of protein kinases or phosphatases activities which participate in transducing the signal activated by binding of a bitter compound (e.g., PTC) to a variant T2R bitter taste receptor). The identification and use of such compounds which affect another step in a variant T2R bitter taste receptor signal transduction pathway in which a variant T2R bitter taste receptor and/or variant T2R bitter taste receptor gene product is involved and, by affecting this same pathway may modulate the effect of variant T2R bitter taste receptor on the sensitivity to bitter tastes are within the scope of the invention. Such compounds can be used as part of a therapeutic method for modulating bitter tastes.

Cell-based systems, membrane vesicle-based systems and membrane fraction-based systems can be used to identify compounds that may act to modulate bitter tastes. Such cell systems can include, for example, recombinant or non-recombinant cells, such as cell lines, which express the PTC taste receptor gene. In addition, expression host cells (e.g., COS cells, CHO cells, HE 293 cells) genetically engineered to express a functional variant T2R bitter taste receptor and to respond to activation by the natural ligand, e.g., as measured by a chemical or phenotypic change, induction of another host cell gene, change in ion flux (e.g., $Ca^{2+}$), phosphorylation of host cell proteins, etc., can be used as an end point in the assay.

In utilizing such cell systems, cells may be exposed to a compound suspected of exhibiting an ability to modulate bitter tastes, at a sufficient concentration and for a time sufficient to elicit such a modulation in the exposed cells. After exposure, the cells can be assayed to measure alterations in the expression of a variant T2R bitter taste receptor gene, e.g., by assaying cell lysates for PTC taste receptor mRNA transcripts (e.g., by Northern analysis) or for variant T2R bitter taste receptor protein expressed in the cell; compounds which regulate or modulate expression of a variant T2R bitter taste receptor gene are good candidates as therapeutics. Alternatively, the cells are examined to determine whether one or more cellular phenotypes has been altered to resemble a taster or nontaster type. Still further, the expression and/or activity of components of the signal transduction pathway of which a variant T2R bitter taste receptor is a part, or the activity of a T2R bitter taste receptor signal transduction pathway itself can be assayed.

For example, after exposure, the cell lysates can be assayed for the presence of phosphorylation of host cell proteins, as compared to lysates derived from unexposed control cells. The ability of a test compound to inhibit phosphorylation of host cell proteins in these assay systems indicates that the test compound alters signal transduction initiated by taste receptor activation. The cell lysates can be readily assayed using a Western blot format; i.e., the host cell proteins are resolved by gel electrophoresis, transferred and probed using a detection antibody (e.g., an antibody labeled with a signal generating compound, such as radiolabel, fluor, enzyme, etc.), see, e.g., Glenney et al., *J Immunol Methods* 109:277-285, 1988; Frackelton et al., *Mol Cell Biol* 3:1343-1352, 1983. Alternatively, an ELISA format could be used in which a particular host cell protein involved in the taste receptor signal transduction pathway is immobilized using an anchoring antibody specific for the target host cell protein, and the presence or absence of a phosphorylated residue on the immobilized host cell protein is detected using a labeled antibody. (See, e.g., King et al., *Life Sci* 53:1465-1472, 1993).

In yet another approach, ion flux, such as calcium ion flux, can be measured as an end point for PTC taste receptor stimulated signal transduction. Calcium flux can be measured, for instance, using calcium-sensitive dyes or probes, many of which are known to those of ordinary skill in the art. Examples of ion sensitive fluorophores include, but are not limited to, bis-(1,3-dibutylbarbituric acid)trimethine oxonol (DiBAC4(3) (B-438), Quin-2 (AM Q-1288), Fura-2 (AM F-1225), Indo-1 (AM I-1226), Fura-3 (AM F-1228), Fluo-3 (AM F-1241), Rhod-2, (AM R-1244), BAPTA (AM B-1205), 5,5'-dimethyl BAPTA (AM D-1207), 4,4'-difluoro BAPTA (AM D-1216), 5,5'-difluoro BAPTA (AM D-1209), 5,5'-dibromo BAPTA (AM D-1213), Calcium Green (C-3011), Calcium Orange (C-3014), Calcium Crimson (C-3017), Fura-5 (F-3023), Fura-Red (F-3020), SBFI (S-1262), PBFI (P-1265), Mag-Fura-2 (AM M-1291), Mag-Indo-1 (AM M-1294), Mag-Quin-2 (AM M-1299), Mag-Quin-1 (AM M-1297), SPQ (M-440), SPA (S-460), Calcien (Fluorescein-bis(methyliminodiacetic acid); Fluorexon), and Quin-2 (2-{[2-Bis-(carboxymethyl)amino-5-methylphenoxy]-methyl}-6-methoxy-8-bis-(carboxymethyl)aminoquinoline tetrapotassium salt).

Example 17

Other Assays for Modulators of Variant T2R Bitter Taste Receptors

A. Assays for Taste Receptor Protein Activity

T2R bitter taste receptor family members are G-protein coupled receptors that participate in taste transduction, e.g., bitter taste transduction. The activity of a T2R bitter taste receptor protein variants can be assessed using a variety of in vitro and in vivo assays to determine functional, chemical, and physical effects, e.g., measuring ligand binding (e.g., radioactive ligand binding), second messengers (e.g., cAMP, cGMP, $IP_3$, DAG, or $Ca^{2+}$), ion flux, phosphorylation levels, transcription levels, neurotransmitter levels, and the like. Furthermore, such assays can be used to test for inhibitors and activators of identified T2R bitter taste receptor family member variants. Modulators can also be genetically altered versions of taste receptors. Such modulators of taste transduction activity are useful for customizing taste, for example to modify the detection of bitter tastes.

Modulators of a T2R bitter taste receptor protein variant activity are tested using taste receptor polypeptides as described herein, either recombinant or naturally occurring. The protein can be isolated, expressed in a cell, expressed in a membrane derived from a cell, expressed in tissue or in an animal, either recombinant or naturally occurring. For example, tongue slices, dissociated cells from a tongue, transformed cells, or membranes can be used. Modulation is tested using one of the in vitro or in vivo assays described herein. Taste transduction can also be examined in vitro with soluble or solid state reactions, using a full-length taste receptor or a chimeric molecule such as an extracellular domain or transmembrane domain, or combination thereof, of a taste receptor variant covalently linked to a heterologous signal transduction domain, or a heterologous extracellular domain and/or transmembrane domain covalently linked to the transmembrane and/or cytoplasmic domain of a T2R bitter taste receptor protein variant. Furthermore, ligand-binding domains of the protein of interest can be used in vitro in soluble or solid state reactions to assay for ligand binding. In numerous embodiments, a chimeric receptor will be made that comprises all or part of a T2R bitter taste receptor protein variant as well an additional sequence that facilitates the localization of the taste receptor to the membrane, such as a rhodopsin, e.g., an N-terminal fragment of a rhodopsin protein.

Ligand binding a T2R bitter taste receptor protein variant, a domain, or chimeric protein can be tested in solution, in a bilayer membrane, attached to a solid phase, in a lipid monolayer, or in vesicles. Binding of a modulator can be tested using, e.g., changes in spectroscopic characteristics (e.g., fluorescence, absorbance, refractive index) hydrodynamic (e.g., shape), chromatographic, or solubility properties.

Receptor-G-protein interactions can also be examined. For example, binding of the G-protein to the receptor or its release from the receptor can be examined. For example, in the absence of GTP, an activator will lead to the formation of a tight complex of a G protein (all three known subunits) with the receptor. This complex can be detected in a variety of ways, as noted above. Such an assay can be modified to search for inhibitors, e.g., by adding an activator to the receptor and G protein in the absence of GTP, which form a tight complex, and then screen for inhibitors by looking at dissociation of the receptor-G protein complex. In the presence of GTP, release of the known alpha subunit of the G protein from the other two known G protein subunits serves as a criterion of activation.

In a convenient embodiment, T2R bitter taste receptor protein variant-gustducin interactions are monitored as a function of taste receptor activation. One taste-cell specific G protein that has been identified is called gustducin (McLaughlin et al. *Nature* 357:563-569, 1992). Such ligand dependent coupling of taste receptors with gustducin can be used as a marker to identify modifiers of the T2R bitter taste receptor protein variant.

An activated or inhibited G-protein will in turn alter the properties of target enzymes, channels, and other effector proteins. The classic examples are the activation of cGMP phosphodiesterase by transducin in the visual system, adenylate cyclase by the stimulatory G-protein, phospholipase C by Gq and other cognate G proteins, and modulation of diverse channels by Gi and other G proteins. Downstream consequences can also be examined such as generation of diacyl glycerol and IP3 by phospholipase C, and in turn, for calcium mobilization by IP3.

In a convenient embodiment, a T2R bitter taste receptor protein variant is expressed in a eukaryotic cell as a chimeric receptor with a heterologous, chaperone sequence that facilitates its maturation and targeting through the secretory pathway. In a preferred embodiment, the heterologous sequence is a rhodopsin sequence, such as an N-terminal leader of a rhodopsin. Such chimeric taste receptors can be expressed in any eukaryotic cell, such as HEK293 cells. Preferably, the cells comprise a functional G protein, e.g., Gα15, that is capable of coupling the chimeric receptor to an intracellular signaling pathway or to a signaling protein such as phospholipase Cβ. Activation of such chimeric receptors in such cells can be detected using any standard method, such as by detecting changes in intracellular calcium by detecting FURA-2 dependent fluorescence in the cell.

An activated G-protein coupled receptor (GPCR) becomes a substrate for kinases that phosphorylate the C-terminal tail of the receptor (and possibly other sites as well). Thus, activators will promote the transfer of $^{32}P$ from gamma-labeled GTP to the receptor, which can be assayed with a scintillation counter. The phosphorylation of the C-terminal tail will promote the binding of arrestin-like proteins and will interfere with the binding of G-proteins. The kinase/arrestin pathway plays a key role in the desensitization of many GPCR receptors. For example, compounds that modulate the duration a taste receptor stays active would be useful as a means of prolonging a desired taste or cutting off an unpleasant one. For a general review of GPCR signal transduction and methods of assaying signal transduction, see, e.g., *Methods in Enzymology*, vols. 237 and 238 (1994) and volume 96 (1983); Bourne et al., *Nature* 10:349:117-127, 1991; Bourne et al., *Nature* 348:125-132, 1990; Pitcher et al., *Annu Rev Biochem* 67:653-692, 1998.

Samples or assays that are treated with a potential T2R bitter taste receptor protein variant inhibitor or activator are compared to control samples without the test compound, to examine the extent of modulation. Such assays may be carried out in the presence of a bitter tastant that is known to activate the particular receptor, and modulation of the bitter-tastant-dependent activation monitored. Control samples (untreated with activators or inhibitors) are assigned a relative T2R bitter taste receptor protein activity value of 100. Inhibition of a T2R bitter taste receptor protein variant is achieved when the T2R bitter taste receptor protein variant activity value relative to the control is about 90%, optionally 50%, optionally 25-0%. Activation of a T2R bitter taste receptor protein variant is achieved when the T2R bitter taste receptor protein variant activity value relative to the control is 110%, optionally 150%, 200-500%, or 1000-2000%.

Changes in ion flux may be assessed by determining changes in polarization (i.e., electrical potential) of the cell or membrane expressing a T2R bitter taste receptor protein variant. One means to determine changes in cellular polarization is by measuring changes in current (thereby measuring changes in polarization) with voltage-clamp and patch-clamp techniques, e.g., the "cell-attached" mode, the "inside-out" mode, and the "whole cell" mode (see, e.g., Ackerman et al., *New Engl J Med* 336:1575-1595, 1997). Whole cell currents are conveniently determined using the standard methodology (see, e.g., Hamil et al., *Pflugers Archiv* 391:85, 1981). Other known assays include: radiolabeled ion flux assays and fluorescence assays using voltage-sensitive dyes (see, e.g., Vestergarrd-Bogind et al., *J Membrane Biol* 88:67-75, 1988; Gonzales & Tsien, *Chem Biol* 4:269-277, 1997; Daniel et al., *J Pharmacol Meth* 25:185-193, 1991; Holevinsky et al., *J Membrane Biology* 137:59-70, 1994). Generally, the compounds to be tested are present in the range from 1 pM to 100 mM.

The effects of the test compounds upon the function of the polypeptides can be measured by examining any of the parameters described above. Any suitable physiological change that affects GPCR activity can be used to assess the influence of a test compound on the polypeptides of this invention. When the functional consequences are determined using intact cells or animals, one can also measure a variety of effects such as transmitter release, hormone release, transcriptional changes to both known and uncharacterized genetic markers (e.g., northern blots), changes in cell metabolism such as cell growth or pH changes, and changes in intracellular second messengers such as $Ca^{2+}$, IP3, cGMP, or cAMP.

Convenient assays for G-protein coupled receptors include cells that are loaded with ion or voltage sensitive dyes to report receptor activity. Assays for determining activity of such receptors can also use known agonists and antagonists for other G-protein coupled receptors as negative or positive controls to assess activity of tested compounds. In assays for identifying modulatory compounds (e.g., agonists, antagonists), changes in the level of ions in the cytoplasm or membrane voltage will be monitored using an ion sensitive or membrane voltage fluorescent indicator, respectively. Among the ion-sensitive indicators and voltage probes that may be employed are those disclosed in the Molecular Probes 1997 Catalog. For G-protein coupled receptors, promiscuous G-proteins such as $G\alpha15$ and $G\alpha16$ can be used in the assay of choice (Wilkie et al. *PNAS USA* 88:10049-10053, 1991). Such promiscuous G-proteins allow coupling of a wide range of receptors.

Receptor activation typically initiates subsequent intracellular events, e.g., increases in second messengers such as IP3, which releases intracellular stores of calcium ions. Activation of some G-protein coupled receptors stimulates the formation of inositol triphosphate (IP3) through phospholipase C-mediated hydrolysis of phosphatidylinositol (Berridge & Irvine *Nature*, 312:315-321, 1984). IP3 in turn stimulates the release of intracellular calcium ion stores. Thus, a change in cytoplasmic calcium ion levels, or a change in second messenger levels such as IP3 can be used to assess G-protein coupled receptor function. Cells expressing such G-protein coupled receptors may exhibit increased cytoplasmic calcium levels as a result of contribution from both intracellular stores and via activation of ion channels, in which case it may be desirable although not necessary to conduct such assays in calcium-free buffer, optionally supplemented with a chelating agent such as EGTA, to distinguish fluorescence response resulting from calcium release from internal stores.

Other assays can involve determining the activity of receptors which, when activated, result in a change in the level of intracellular cyclic nucleotides, e.g., cAMP or cGMP, by activating or inhibiting enzymes such as adenylate cyclase. There are cyclic nucleotide-gated ion channels, e.g., rod photoreceptor cell channels and olfactory neuron channels that are permeable to cations upon activation by binding of cAMP or cGMP (see, e.g., Altenhofen et al., *PNAS USA* 88:9868-9872, 1991; and Dhallan et al., *Nature* 347:184-187, 1990). In cases where activation of the receptor results in a decrease in cyclic nucleotide levels, it may be preferable to expose the cells to agents that increase intracellular cyclic nucleotide levels, e.g., forskolin, prior to adding a receptor-activating compound to the cells in the assay. Cells for this type of assay can be made by co-transfection of a host cell with DNA encoding a cyclic nucleotide-crated ion channel, GPCR phosphatase and DNA encoding a receptor (e.g., certain glutamate receptors, muscarinic acetylcholine receptors, dopamine receptors, serotonin receptors, and the like), which, when activated, causes a change in cyclic nucleotide levels in the cytoplasm.

In a convenient embodiment, a T2R bitter taste receptor protein variant activity is measured by expressing a T2R bitter taste receptor protein variant gene in a heterologous cell with a promiscuous G-protein that links the receptor to a phospholipase C signal transduction pathway (see, Offermanns & Simon, *J Biol Chem* 270:15175-15180, 1995). Optionally the cell line is HEK293 (which does not naturally express PTC taste receptor genes and the promiscuous G-protein is $G\alpha15$ (Offermanns & Simon, 1995). Modulation of taste transduction is assayed by measuring changes in intracellular $Ca^{2+}$ levels, which change in response to modulation of the a T2R bitter taste receptor protein variant signal transduction pathway via administration of a molecule that associates with a T2R bitter taste receptor protein variant. Changes in $Ca^{2+}$ levels are optionally measured using fluorescent $Ca^{2+}$ indicator dyes and fluorometric imaging. Examples of ion sensitive dyes and probes include, but are not limited to, bis-(1,3-dibutylbarbituric acid)trimethine oxonol (DiBAC4(3) (B-438), Quin-2 (AM Q-1288), Fura-2 (AM F-1225), Indo-1 (AM I-1226), Fura-3 (AM F-1228), Fluo-3 (AM F-1241), Rhod-2, (AM R-1244), BAPTA (AM B-1205), 5,5'-dimethyl BAPTA (AM D-1207), 4,4'-difluoro BAPTA (AM D-1216), 5,5'-difluoro BAPTA (AM D-1209), 5,5'-dibromo BAPTA (AM D-1213), Calcium Green (C-3011), Calcium Orange (C-3014), Calcium Crimson (C-3017), Fura-5 (F-3023), Fura-Red (F-3020), SBFI (S-1262), PBFI (P-1265), Mag-Fura-2 (AM M-1291), Mag-Indo-1 (AM M-1294), Mag-Quin-2 (AM M-1299), Mag-Quin-1 (AM M-1297), SPQ (M-440), SPA (S-460), Calcien (Fluorescein-bis(methyliminodiacetic acid); Fluorexon), and Quin-2 (2-{[2-Bis-(carboxymethyl)amino-5-methylphenoxy]-methyl}-6-methoxy-8-bis-(carboxymethyl)aminoquinoline tetrapotassium salt).

In one embodiment, the changes in intracellular cAMP or cGMP can be measured using immunoassays. The method described in Offermanns & Simon (*J Biol Chem* 270:15175-15180, 1995), for instance, may be used to determine the level of cAMP. Also, the method described in Felley-Bosco et al. (*Am J Resp Cell and Mol Biol* 11:159-164, 1994) may be used to determine the level of cGMP. Further, an assay kit for measuring cAMP and/or cGMP is described in U.S. Pat. No. 4,115,538.

In another embodiment, phosphatidyl inositol (PI) hydrolysis can be analyzed according to U.S. Pat. No. 5,436,128. Briefly, the assay involves labeling of cells with $^3$H-myo-inositol for 48 or more hours. The labeled cells are treated with a test compound for one hour. The treated cells are lysed and extracted in chloroform-methanol-water after which the inositol phosphates are separated by ion exchange chromatography and quantified by scintillation counting. Fold stimulation is determined by calculating the ratio of cpm in the presence of agonist to cpm in the presence of buffer control. Likewise, fold inhibition is determined by calculating the ratio of cpm in the presence of antagonist to cpm in the presence of buffer control (which may or may not contain an agonist).

In another embodiment, transcription levels can be measured to assess the effects of a test compound on signal transduction. A host cell containing a T2R bitter taste receptor protein variant of interest is contacted with a test compound for a sufficient time to effect any interactions, and then the level of gene expression is measured. The amount of time to effect such interactions may be empirically determined, such as by running a time course and measuring the level of transcription as a function of time. The amount of transcription may be measured by using any method known to those of skill in the art to be suitable. For example, mRNA expression of the protein of interest may be detected using northern blots or their polypeptide products may be identified using immunoassays. Alternatively, transcription based assays using reporter genes may be used as described in U.S. Pat. No. 5,436,128. The reporter genes can be, e.g., chloramphenicol acetyltransferase, luciferase, β-galactosidase and alkaline phosphatase. Furthermore, the protein of interest can be used as an indirect reporter via attachment to a second reporter such as green fluorescent protein (see, e.g., Mistili & Spector, *Nature Biotechnology* 15:961-964, 1997).

The amount of transcription is then compared to the amount of transcription in either the same cell in the absence of the test compound, or it may be compared with the amount of transcription in a substantially identical cell that lacks the protein of interest. A substantially identical cell may be derived from the same cells from which the recombinant cell was prepared but which had not been modified by introduction of heterologous DNA. Any difference in the amount of transcription indicates that the test compound has in some manner altered the activity of the protein of interest.

B. Modulators

The compounds tested as modulators of a T2R bitter taste receptor family member variant can be any small chemical compound, or a biological entity, such as a protein, sugar, nucleic acid or lipid. Alternatively, modulators can be genetically altered versions of a T2R bitter taste receptor protein gene. Typically, test compounds will be small chemical molecules and peptides. Essentially any chemical compound can be used as a potential modulator or ligand in the assays of the invention, although most often compounds dissolved in aqueous or organic (especially DMSO-based) solutions are used. The assays are designed to screen large chemical libraries by automating the assay steps and providing compounds from any convenient source to assays, which are typically run in parallel (e.g., in microtiter formats on microtiter plates in robotic assays). It will be appreciated that there are many suppliers of chemical compounds, including Sigma (St. Louis, Mo.), Aldrich (St. Louis, Mo.), Sigma-Aldrich (St. Louis, Mo.), Fluka Chemika-Biochemica Analytika (Buchs, Switzerland) and the like.

In one convenient embodiment, high throughput screening methods involve providing a combinatorial chemical or peptide library containing a large number of potential therapeutic compounds (potential modulator or ligand compounds). Such "combinatorial chemical libraries" or "ligand libraries" are then screened in one or more assays, as described herein, to identify those library members (particularly chemical species or subclasses) that display a desired characteristic activity. The compounds thus identified can serve as conventional "lead compounds" or can themselves be used as potential or actual therapeutics.

A combinatorial chemical library is a collection of diverse chemical compounds generated by either chemical synthesis or biological synthesis, by combining a number of chemical "building blocks" such as reagents. For example, a linear combinatorial chemical library such as a polypeptide library is formed by combining a set of chemical building blocks (amino acids) in every possible way for a given compound length (i.e., the number of amino acids in a polypeptide compound). Millions of chemical compounds can be synthesized through such combinatorial mixing of chemical building blocks.

Preparation and screening of combinatorial chemical libraries is well known to those of skill in the art. Such combinatorial chemical libraries include, but are not limited to, peptide libraries (see, e.g., U.S. Pat. No. 5,010,175; Furka, *Int J Pept Prot Res* 37:487-493, 1991; and Houghton et al., *Nature* 354:84-88, 1991). Other chemistries for generating chemical diversity libraries can also be used. Such chemistries include, but are not limited to: peptides (e.g., PCT Publication No. WO 91/19735), encoded peptides (e.g., PCT Publication WO 93/20242), random bio-oligomers (e.g., PCT Publication No. WO 92/00091), benzodiazepines (e.g., U.S. Pat. No. 5,288,514), diversomers such as hydantoins, benzodiazepines and dipeptides (Hobbs et al., *PNAS USA* 90:6909-6913, 1993), vinylogous polypeptides (Hagihara et al., *J Amer Chem Soc* 114:6568, 1992), nonpeptidal peptidomimetics with glucose scaffolding (Hirschmann et al., *J Amer Chem Soc* 114:9217-9218, 1992), analogous organic syntheses of small compound libraries (Chen et al., *J Amer Chem Soc* 116:2661, 1994), oligocarbamates (Cho et al. 1993 *Science* 261:1303), and/or peptidyl phosphonates (Campbell et al., *J Org Chem* 59:658, 1994), nucleic acid libraries (see Sambrook et al. *Molecular Cloning, A Laboratory Manual*, Cold Springs Harbor Press, N.Y., 1989; and Ausubel et al. *Current Protocols in Molecular Biology* Green Publishing Associates and Wiley Interscience, N.Y., 1989), peptide nucleic acid libraries (see, e.g., U.S. Pat. No. 5,539,083), antibody libraries (see, e.g., Vaughn et al. *Nature Biotechnology* 14:309-314, 1996; and PCT/US96/10287), carbohydrate libraries (see, e.g., Liang et al., *Science* 274:1520-1522, 1996; and U.S. Pat. No. 5,593,853), small organic molecule libraries (see, e.g., benzodiazepines, Baum 1993 C&EN, January 18, page 33; isoprenoids, U.S. Pat. No. 5,569,588; thiazolidionones and methathiazones, U.S. Pat. No. 5,549,974; pyrrolidines, U.S. Pat. Nos. 5,525,735 and 5,519,134; morpholino compounds, U.S. Pat. No. 5,506,337; benzodiazepines, U.S. Pat. No. 5,288,514, and the like).

Devices for the preparation of combinatorial libraries are commercially available (see, e.g., 357 MPS, 390 MPS, Advanced Chem Tech, Louisville, Ky.; Symphony, Rainin, Woburn, Mass.; 433A Applied Biosystems, Foster City, Calif.; 9050 Plus, Millipore, Bedford, Mass.). In addition, numerous combinatorial libraries are themselves commercially available (see, e.g., ComGenex, Princeton, N.J.; Tripos, Inc., St. Louis, Mo.; 3D Pharmaceuticals, Exton, Pa.; Martek Biosciences, Columbia, Md.; etc.).

C. Solid State and Soluble High Throughput Assays

In one embodiment is provided soluble assays using molecules such as a domain such as a ligand binding domain, an extracellular domain, a transmembrane domain, a transmembrane domain and a cytoplasmic domain, an active site, a subunit association region, etc.; a domain that is covalently linked to a heterologous protein to create a chimeric molecule; a T2R bitter taste receptor protein variant/isoform; or a cell or tissue expressing a T2R bitter taste receptor protein variant/isoform, either naturally occurring or recombinant. Another embodiment provides solid phase based in vitro assays in a high throughput format, where the domain, chimeric molecule, T2R bitter taste receptor protein variant/isoform, or cell or tissue expressing a specific T2R bitter taste receptor variant is attached to a solid phase substrate. It is particularly contemplated in some embodiments that multiple molecules are provided in such assays, for instance, a collection of two or more T2R isoforms proteins, or fragments thereof, such as those isoforms shown in SEQ ID NOs: 4, 8, 10, 12, 14, 16, 20, 22, 24, 26, 28, 30, 32, 34, 36, 40, 42, 46, 50, 56, 58, 60, 64, 66, 68, 70, 72, 76, 78, 80, 82, 84, 86, 90, 92, 94, 96, 100, 102, 104, 106, 108, 112, 114, 116, 118, 120, 122, 124, 126, 128, 130, 136, 140, 142, 148, 150, 152, 156, 158, 162, 164, 170, 174, 176, 178, 180, 182, 184, 188, 190, 192, 198, 200, 202, 204, 206, 210, 212, 214, 218, 220, 226, 228, 230, 232, 234, 236, 238, 242, 244, 246, 248, 250, 252, 254, 258, 260, 264.

In the high throughput assays, it is possible to screen up to several thousand different modulators or ligands in a single day. In particular, each well of a microtiter plate can be used to run a separate assay against a selected potential modulator, or, if concentration or incubation time effects are to be observed, every 5-10 wells can test a single modulator. Thus, a single standard microtiter plate can assay about 100 (e.g., 96) modulators. If 1536 well plates are used, then a single plate can easily assay from about 100- about 1500 different compounds. It is possible to assay several different plates per day; assay screens for up to about 6,000-20,000 different compounds are possible using the integrated systems of the invention. More recently, microfluidic approaches to reagent manipulation have been developed.

The molecule of interest can be bound to the solid state component, directly or indirectly, via covalent or non-covalent linkage, e.g., via a tag. The tag can be any of a variety of components. In general, a molecule which binds the tag (a tag binder) is fixed to a solid support, and the tagged molecule of interest (e.g., the taste transduction molecule of interest) is attached to the solid support by interaction of the tag and the tag binder.

A number of tags and tag binders can be used, based upon known molecular interactions well described in the literature. For example, where a tag has a natural binder, for example, biotin, protein A, or protein G, it can be used in conjunction with appropriate tag binders (avidin, streptavidin, neutravidin, the Fc region of an immunoglobulin, etc.). Antibodies to molecules with natural binders such as biotin are also widely available and appropriate tag binders; see, SIGMA Immunochemicals 1998 catalogue SIGMA, St. Louis, Mo.

Similarly, any haptenic or antigenic compound can be used in combination with an appropriate antibody to form a tag/tag binder pair. Thousands of specific antibodies are commercially available and many additional antibodies are described in the literature. For example, in one common configuration, the tag is a first antibody and the tag binder is a second antibody which recognizes the first antibody. In addition to antibody-antigen interactions, receptor-ligand interactions are also appropriate as tag and tag-binder pairs. For example, agonists and antagonists of cell membrane receptors (e.g., cell receptor-ligand interactions such as transferrin, viral receptor ligands, cytokine receptors, chemokine receptors, interleukin receptors, immunoglobulin receptors and antibodies, the cadherein family, the integrin family, the selectin family, and the like; (see, e.g., Pigott & Power 1993 *The Adhesion Molecule Facts Book I*). Similarly, toxins and venoms, viral epitopes, hormones (e.g., opiates, steroids, etc.), intracellular receptors (e.g., which mediate the effects of various small ligands, including steroids, thyroid hormone, retinoids and vitamin D; peptides), drugs, lectins, sugars, nucleic acids (both linear and cyclic polymer configurations), oligosaccharides, proteins, phospholipids and antibodies can all interact with various cell receptors.

Synthetic polymers, such as polyurethanes, polyesters, polycarbonates, polyureas, polyamides, polyethyleneimines, polyarylene sulfides, polysiloxanes, polyimides, and polyacetates can also form an appropriate tag or tag binder. Many other tag/tag binder pairs are also useful in assay systems described herein, as would be apparent to one of skill upon review of this disclosure.

Common linkers such as peptides, polyethers, and the like can also serve as tags, and include polypeptide sequences, such as poly gly sequences of between about 5 and 200 amino acids. Such flexible linkers are known to persons of skill in the art. For example, poly(ethelyne glycol) linkers are available from Shearwater Polymers, Inc. Huntsville, Ala. These linkers optionally have amide linkages, sulfhydryl linkages, or heterofunctional linkages.

Tag binders are fixed to solid substrates using any of a variety of methods currently available. Solid substrates are commonly derivatized or functionalized by exposing all or a portion of the substrate to a chemical reagent which fixes a chemical group to the surface which is reactive with a portion of the tag binder. For example, groups which are suitable for attachment to a longer chain portion would include amines, hydroxyl, thiol, and carboxyl groups. Aminoalkylsilanes and hydroxyalkylsilanes can be used to functionalize a variety of surfaces, such as glass surfaces. The construction of such solid phase biopolymer arrays is well described in the literature. See, e.g., Merrifield, *J Am Chem Soc* 85:2149-2154, 1963 (describing solid phase synthesis of, e.g., peptides); Geysen et al., *J Immun Meth* 102:259-274, 1987 (describing synthesis of solid phase components on pins); Frank & Doring, *Tetrahedron* 44:6031-6040, 1988 (describing synthesis of various peptide sequences on cellulose disks); Fodor et al., *Science* 251:767-777, 1991; Sheldon et al., *Clinical Chemistry* 39:718-719, 1993; and Kozal et al., *Nature Medicine* 2:753759, 1996 (all describing arrays of biopolymers fixed to solid substrates). Non-chemical approaches for fixing tag binders to substrates include other common methods, such as heat, cross-linking by UV radiation, and the like.

D. Computer-Based Assays

Yet another assay for compounds that modulate taste receptor protein activity involves computer assisted drug design, in which a computer system is used to generate a three-dimensional structure of a target taste receptor protein based on the structural information encoded by its amino acid sequence. The input amino acid sequence interacts directly and actively with a preestablished algorithm in a computer program to yield secondary, tertiary, and quaternary structural models of the protein. The models of the protein structure are then examined to identify regions of the structure that have the ability to bind, e.g., ligands. These regions are then used to identify ligands that bind to the protein.

The three-dimensional structural model of the protein is generated by entering protein amino acid sequences of at least 10 amino acid residues or corresponding nucleic acid sequences encoding a T2R bitter taste receptor polypeptide allelic variant into the computer system. The nucleotide sequence encoding the polypeptide, or the amino acid sequence thereof, can be any of the allelic variant taste receptors described. The amino acid sequence represents the primary sequence or subsequence of the protein, which encodes the structural information of the protein. At least 10 residues of the amino acid sequence (or a nucleotide sequence encoding 10 amino acids) are entered into the computer system from computer keyboards, computer readable substrates that include, but are not limited to, electronic storage media (e.g., magnetic diskettes, tapes, cartridges, and chips), optical media (e.g., CD ROM), information distributed by internet sites, and by RAM. The three-dimensional structural model of the protein is then generated by the interaction of the amino acid sequence and the computer system, using software known to those of skill in the art.

The amino acid sequence represents a primary structure that encodes the information necessary to form the secondary, tertiary and quaternary structure of the protein of interest. The software looks at certain parameters encoded by the primary sequence to generate the structural model. These parameters are referred to as "energy terms," and primarily include electrostatic potentials, hydrophobic potentials, solvent accessible surfaces, and hydrogen bonding. Secondary energy terms include van der Walls potentials. Biological molecules form the structures that minimize the energy terms in a cumulative fashion. The computer program is therefore using these terms encoded by the primary structure or amino acid sequence to create the secondary structural model. An example for G-protein cell receptors is presented in Vaidehi et al. (*PNAS* 99:15308-15312, 2002), which is incorporated herein by reference in its entirety.

The tertiary structure of the protein encoded by the secondary structure is then formed on the basis of the energy terms of the secondary structure. The user at this point can enter additional variables such as whether the protein is membrane bound or soluble, its location in the body, and its cellular location, e.g., cytoplasmic, surface, or nuclear. These variable along with the energy terms of the secondary structure are used to form the model of the tertiary structure. In modeling the tertiary structure, the computer program matches hydrophobic faces of secondary structure with like, and hydrophilic faces of secondary structure with like.

Once the structure has been granted, potential ligand binding regions are identified by the computer system. Three-dimensional structures for potential ligands are generated by entering amino acid or nucleotide sequences or chemical formulas of compounds, as described above. The three-dimensional structure of the potential ligand is then compared to that of the target taste receptor protein variant to identify ligands that bind to the protein. Binding affinity between the protein and ligands is determined using energy terms to determine which ligands have an enhanced probability of binding to the protein.

Example 18

Pharmaceutical Preparations and Methods of Administration

Taste modulators can be administered directly to the mammalian subject for modulation of taste, e.g., modulation of bitter taste, in vivo. Administration is by any of the routes normally used for introducing a modulator compound into ultimate contact with the tissue to be treated, optionally the tongue or mouth. The taste modulators are administered in any suitable manner, optionally with pharmaceutically acceptable carriers. Suitable methods of administering such modulators are available and well known to those of skill in the art, and, although more than one route can be used to administer a particular composition, a particular route can often provide a more immediate and more effective reaction than another route.

Pharmaceutically acceptable carriers are determined in part by the particular composition being administered, as well as by the particular method used to administer the composition. Accordingly, there is a wide variety of suitable formulations of pharmaceutical compositions of the present invention (see, e.g., *Remington's Pharmaceutical Sciences*, 17$^{th}$ ed. 1985).

Formulations suitable for administration include aqueous and non-aqueous solutions, isotonic sterile solutions, which can contain antioxidants, buffers, bacteriostats, and solutes that render the formulation isotonic, and aqueous and non-aqueous sterile suspensions that can include suspending agents, solubilizers, thickening agents, stabilizers, and preservatives. In the practice of this invention, compositions can be administered, for example, orally. The formulations of compounds can be presented in unit-dose or multi-dose sealed containers, such as ampoules and vials. Solutions and suspensions can be prepared from sterile powders, granules, and tablets of the kind previously described. The modulators can also be administered as part of a prepared food or drug.

The dose administered to a patient, in the context of the present invention should be sufficient to effect a beneficial response in the subject over time. The dose will be determined by the efficacy of the particular taste modulators employed and the condition of the subject, as well as the body weight or surface area of the area to be treated. The size of the dose also will be determined by the existence, nature, and extent of any adverse side-effects that accompany the administration of a particular compound in a particular subject.

In determining the effective amounts of the modulator to be administered, a physician may evaluate circulating plasma levels of the modulator, modulator toxicities, and the production of anti-modulator antibodies. In general, the dose equivalent of a modulator is from about 1 ng/kg to 10 mg/kg for a typical subject.

For administration, taste modulators of the present invention can be administered at a rate determined by the $LD_{50}$ of the modulator, and the side effects of the inhibitor at various concentrations, as applied to the mass and overall health of the subject. Administration can be accomplished via single or divided doses.

Example 19

Kits

Kits are provided which contain reagents useful for determining the presence or absence of polymorphism(s) in at least one T2R-encoding sequence, such as probes or primers specific for a T2R SNP shown in FIG. 1, or a T2R haplotype allele shown in Table 7. Such kits can be used with the methods described herein to determine a subject's T2R genotype or haplotype, for one or more T2R genes.

The provided kits may also include written instructions. The instructions can provide calibration curves or charts to compare with the determined (e.g., experimentally measured) values.

The oligonucleotide probes and primers disclosed herein can be supplied in the form of a kit for use in detection of a specific T2R sequence, such as a SNP or haplotype described herein, in a subject. In such a kit, an appropriate amount of one or more of the oligonucleotide primers is provided in one or more containers. The oligonucleotide primers may be provided suspended in an aqueous solution or as a freeze-dried or lyophilized powder, for instance. The container(s) in which the oligonucleotide(s) are supplied can be any conventional container that is capable of holding the supplied form, for instance, microfuge tubes, ampoules, or bottles. In some applications, pairs of primers may be provided in pre-measured single use amounts in individual, typically disposable, tubes or equivalent containers. With such an arrangement, the sample to be tested for the presence of a T2R polymorphism can be added to the individual tubes and amplification carried out directly.

The amount of each oligonucleotide primer supplied in the kit can be any appropriate amount, depending for instance on the market to which the product is directed. For instance, if the kit is adapted for research or clinical use, the amount of each oligonucleotide primer provided would likely be an amount sufficient to prime several PCR amplification reactions. Those of ordinary skill in the art know the amount of oligonucleotide primer that is appropriate for use in a single amplification reaction. General guidelines may for instance be found in Innis et al. (*PCR Protocols, A Guide to Methods and Applications*, Academic Press, Inc., San Diego, Calif., 1990), Sambrook et al. (In *Molecular Cloning: A Laboratory Manual*, Cold Spring Harbor, N.Y., 1989), and Ausubel et al. (In *Current Protocols in Molecular Biology*, Greene Publ. Assoc. and Wiley-Intersciences, 1992).

A kit may include more than two primers, in order to facilitate the in vitro amplification of T2R-encoding sequences, for instance a specific target T2R gene or the 5' or 3' flanking region thereof.

In some embodiments, kits may also include the reagents necessary to carry out nucleotide amplification reactions, including, for instance, DNA sample preparation reagents, appropriate buffers (e.g., polymerase buffer), salts (e.g., magnesium chloride), and deoxyribonucleotides (dNTPs).

Kits may in addition include either labeled or unlabeled oligonucleotide probes for use in detection of T2R polymorphism(s) or haplotypes. In certain embodiments, these probes will be specific for a potential polymorphic site that may be present in the target amplified sequences. The appropriate sequences for such a probe will be any sequence that includes one or more of the identified polymorphic sites, particularly those nucleotide positions indicated in FIG. 1, such that the sequence the probe is complementary to a polymorphic site and the surrounding T2R sequence. By way of example, such probes are of at least 6 nucleotides in length, and the polymorphic site occurs at any position within the length of the probe. It is often beneficial to use longer probes, in order to ensure specificity. Thus, in some embodiments, the probe is at least 8, at least 10, at least 12, at least 15, at least 20, at least 30 nucleotides or longer.

It may also be advantageous to provide in the kit one or more control sequences for use in the amplification reactions. The design of appropriate positive control sequences is well known to one of ordinary skill in the appropriate art. By way of example, control sequences may comprise human (or non-human) T2R nucleic acid molecule(s) with known sequence at one or more target SNP positions, such as those described in FIG. 1.

In some embodiments, kits may also include some or all of the reagents necessary to carry out RT-PCR in vitro amplification reactions, including, for instance, RNA sample preparation reagents (including e.g., an RNase inhibitor), appropriate buffers (e.g., polymerase buffer), salts (e.g., magnesium chloride), and deoxyribonucleotides (dNTPs).

Such kits may in addition include either labeled or unlabeled oligonucleotide probes for use in detection of the in vitro amplified target sequences. The appropriate sequences for such a probe will be any sequence that falls between the annealing sites of the two provided oligonucleotide primers, such that the sequence the probe is complementary to is amplified during the PCR reaction. In certain embodiments, these probes will be specific for a potential polymorphism that may be present in the target amplified sequences.

It may also be advantageous to provide in the kit one or more control sequences for use in the RT-PCR reactions. The design of appropriate positive control sequences is well known to one of ordinary skill in the appropriate art.

Kits for the detection or analysis of T2R protein expression (such as over- or under-expression, or expression of a specific isoform) are also encompassed. Such kits may include at least one target protein specific binding agent (e.g., a polyclonal or monoclonal antibody or antibody fragment that specifically recognizes a T2R protein, or beneficially a specific T2R protein isoform) and may include at least one control (such as a determined amount of target T2R protein, or a sample containing a determined amount of T2R protein). The T2R-protein specific binding agent and control may be contained in separate containers.

T2R protein or isoform expression detection kits may also include a means for detecting T2R:binding agent complexes, for instance the agent may be detectably labeled. If the detectable agent is not labeled, it may be detected by second antibodies or protein A for example which may also be provided in some kits in one or more separate containers. Such techniques are well known.

Additional components in specific kits may include instructions for carrying out the assay. Instructions will allow the tester to determine T2R expression level. Reaction vessels and auxiliary reagents such as chromogens, buffers, enzymes, etc. may also be included in the kits.

Also provided are kits that allow differentiation between individuals who are homozygous versus heterozygous for specific SNPs or haplotypes of the described T2R bitter taste receptors. Examples of such kits provide the materials necessary to perform oligonucleotide ligation assays (OLA), as described at Nickerson et al. (*Proc. Natl. Acad. Sci. USA* 87:8923-8927, 1990). In specific embodiments, these kits contain one or more microtiter plate assays, designed to detect polymorphism(s) in a T2R sequence of a subject, as described herein.

Additional components in some of these kits may include instructions for carrying out the assay. Instructions will allow the tester to determine whether a specified T2R allele is present, and whether it is homozygous or heterozygous. Reaction vessels and auxiliary reagents such as chromogens, buffers, enzymes, etc. may also be included in the kits.

It may also be advantageous to provide in the kit one or more control sequences for use in the OLA reactions. The design of appropriate positive control sequences is well known to one of ordinary skill in the appropriate art.

This disclosure provides a comprehensive collection of SNPs in bitter taste receptor genes, including sub-sets that represent conserved, non-conserved, silent, and truncation mutations in the corresponding proteins, and individual allelic sequences and haplotypes for bitter taste receptor genes. The disclosure further provides methods for using the corresponding allelic variants of the taste receptor genes, alone or in various combinations, to test and characterize a subject's bitter tasting profile and to identify and analyze compounds that interact with and/or influence bitter tastes in different subjects and populations. It will be apparent that the precise details of the methods described may be varied or modified without departing from the spirit of the described invention. We claim all such modifications and variations that fall within the scope and spirit of this disclosure, and all equivalents of such.

SEQUENCE LISTING (264 sequences)

SEQ ID NO: 1 - DNA, 900 bp, Homo sapiens
  CDS (1)..(900)
  variation (332)..(332): r is g or a
  variation (616)..(616): y is t or c
atgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccrtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 2 - protein, 299 aa, Homo sapiens
  misc_feature (111)..(111): The 'Xaa' at location 111 stands for Arg, or His.
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVXHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 3 - DNA, 951 bp, Homo sapiens
  CDS (1)..(951)
  variation (349)..(349): y is t or c
  variation (807)..(807): y is t or c
  variation (852)..(852): y is t or c
atgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcacyccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggygaagtaatgacaatgttttatcctgctggccactcatttattctyattctggggaacagtaagctgaagcagacatttgtagtgatgctccggtgtgagtctggtcatctgaagcctggatccaagggacccattttctcttag

SEQ ID NO: 4 - protein, 316 aa, Homo sapiens
  misc_feature (117)..(117): The 'Xaa' at location 117 stands for Pro, or Ser.
  misc_feature (269)..(269): The 'Xaa' at location 269 stands for Gly.
  misc_feature (284)..(284): The 'Xaa' at location 284 stands for Leu.
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHXTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIXEVMTMFYPAGHSFIXILGNSKLKQTFVVMLRCESGHLKPGSKGPIFS

SEQ ID NO: 5 - DNA, 900 bp, Homo sapiens
  CDS (1)..(900)
  variation (8)..(8): r is a or g
  variation (20)..(20): y is t or c
  variation (186)..(186): w is t or a
  variation (286)..(286): s is c or g
  variation (512)..(512): r is a or g
atgcttcrsttattctattyctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactattwctggtgaacaccatctacttcgtctcttcaaatacggaaaggtcagtctacctgtctgctttttttgtgttgtgtttcatgtttttggactcgagcagtstctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcartgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 6 - protein, 299 aa, Homo sapiens
  misc_feature (3)..(3): The 'Xaa' at location 3 stands for Arg, Gln, or His.
  misc_feature (7)..(7): The 'Xaa' at location 7 stands for Ser, or Phe.
  misc_feature (62)..(62): The 'Xaa' at location 62 stands for Leu, or Phe.
  misc_feature (96)..(96): The 'Xaa' at location 96 stands for Val, or Leu.
  misc_feature (171)..(171): The 'Xaa' at location 171 stands for Ser, or Asn.
MLXLFYXSAIIASVILNFVGIIMNLFITVVNCKTWVKSHRISSSDRILFSLGITRFLMLGLXLVNTIYFVSSNTERSVYLSAFFVLCFMFLDSSSXWFVTLLNILYCVKITNFQHSVFLLLKRNISPKIPRLLLACVLISAFTTCLYITLSQASPFPELVTTRNNTSFNIXEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 7 - DNA, 900 bp, Homo sapiens
  CDS (1)..(900)
  variation (77)..(77): k is g or t
  variation (235)..(235): y is t or c
  variation (338)..(338): y is t or c
  variation (500)..(500): r is a or g
  variation (638)..(638): r is a or g
  variation (881)..(881): k is g or t
atgctgagcgctggcctaggactgctgatgctggtggcagtggttgaatttctcatcggtttaattggaaatggaakcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttygctatcttagtatcttctgggtcctggtaagccaggccagcttatggtttgccaccttcctcagtgtcttctattgcaagaagatcacgaccttcgatcgccyggcctacttgtggctgaagcagagrgcctataacctgagtctctggtgccttctgggctactttataatcaatttgttacttacagtccaaattggcttaacattctatcatcctccccaaggaaacagcagcattcggtatccctttgaaagctggcagtrcctgtatgcatttcagctcaattcaggaagttatttgcctttagtggtgtttcttgtttcctctgggatgctgattgtctctttgtatacacaccacaagaagatgaaggtccattcagctggtaggagggatgtccrggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctckgagatgctggggcccatga

SEQ ID NO: 8 - protein, 299 aa, Homo sapiens
  misc_feature (26)..(26): The 'Xaa' at location 26 stands for Ser, or Ile.
  misc_feature (79)..(79): The 'Xaa' at location 79 stands for Arg, or Cys.
  misc_feature (113)..(113): The 'Xaa' at location 113 stands for Pro, or Leu.
  misc_feature (167)..(167): The 'Xaa' at location 167 stands for Cys, or Tyr.
  misc_feature (213)..(213): The 'Xaa' at location 213 stands for Arg, or Gln.
  misc_feature (294)..(294): The 'Xaa' at location 294 stands for Arg, or Leu.
MLSAGLGLLMLVAVVEFLIGLIGNGXLVVWSFREWIRKFNWSSYNLIILGLAGCRFLLQWLIILDLSLFPLFQSSRWLXYLSIFWVLVSQASLWFATFLSVFYCKKITTFDRXAYLWLKQRAYNLSLWCLLGYFIINLLLTVQIGLTFYHPPQGNSSIRYPFESWQXLYAFQLNSGSYLPLVVFLVSSGMLIVSLYTHHKKMKVHSAGRRDVXAKAHITALKSLGCFLLLHLVYIMASPFSITSKTYPPDLTSVFIWETLMAAYPSLHSLILIMGIPRVKQTCQKILWKTVCAXRCWGP

SEQ ID NO: 9 - DNA, 957 bp, Homo sapiens
  CDS (1)..(957): y is t or c
  variation (788)..(788): y is t or c
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagayggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctga

SEQ ID NO: 10 - protein, 318 aa, Homo sapiens
  misc_feature (263)..(263): The 'Xaa' at location 263 stands for Thr, or Met.
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPEXELAVIFGESIALIYPSSHSFILILGNNKLRHASLKVIWKVMSILKGRKFQQHKQI

SEQ ID NO: 11 - DNA, 930 bp, Homo sapiens
  CDS (1)..(930)
  variation (496)..(496): r is a or g
  variation (549)..(549): r is a or g
  variation (829)..(829): y is t or c
  variation (922)..(922): r is a or g
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaargaaacattactgaaatgttccatgtgagtaaaataccatactttgaacccttractctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctcyaccccttgggtcactcacttattttaattgttttaaataataaactgaggcagacatttgtcagaatgctgacatgtagaaaaattgcctgcrtgatatga

SEQ ID NO: 12 - protein, 309 aa, Homo sapiens
  misc_feature (166)..(166): The 'Xaa' at location 166 stands for Gly, or Arg.
  misc_feature (183)..(183): The 'Xaa' at location 183 stands for Leu.
  misc_feature (277)..(277): The 'Xaa' at location 277 stands for His, or Tyr.
  misc_feature (308)..(308): The 'Xaa' at location 308 stands for Val, or Met.
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKXNITEMFHVSKIPYFEPXTLFNLFAIVPFIVSLISFFLLVRSLWRHTKQIKLYATGSRDPSTEVHVRAIKTMTSFIFFFFLYYISSILMTFSYLMTKYKLAVEFGEIAAILXPLGHSLILIVLNNKLRQTFVRMLTCRKIACXI

SEQ ID NO: 13 - DNA, 939 bp, Homo sapiens
  CDS (1)..(939)
  variation (201)..(201): m is a or c
  variation (450)..(450): w is t or a
  variation (560)..(560): y is c or t
  variation (867)..(867): k is g or t
  variation (880)..(880): m is a or c
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttmtttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgawgatatgtggtatcaccttttcaaagtcagtcatgaagaaaacattacttggaaattcaaagtgagtaaaattccaggtactttcaaacagttaaccctgaacctgggggygatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttkagggaagcttttmtgaagatgttaagatttgtgaagtgtttccttagaagaagaaagccttttgttccatag

SEQ ID NO: 14 - protein, 312 aa, Homo sapiens
  misc_feature (67)..(67): The 'Xaa' at location 67 stands for Leu, or Phe.
  misc_feature (150)..(150): The 'Xaa' at location 150 stands for Glu, or Asp.
  misc_feature (187)..(187): The 'Xaa' at location 187 stands for Ala, or Val.
  misc_feature (289)..(289): The 'Xaa' at location 289 stands for Leu, or Phe.
  misc_feature (294)..(294): The 'Xaa' at location 294 stands for Met, or Leu.
MPSAIEAIYIILIAGELTIGIWGNGFIVLVNCIDWLKRRDISLIDIILISLAISRICLLCVISLDGXFMLLFPGTYGNSVLVSIVNVVWTFANNSSLWFTSCLSIFYLLKIANISHPFFFWLKLKINKVMLAILLGSFLISLIISVPKNXDMWYHLFKVSHEENITWKFKVSKIPGTFKQLTLNLGXMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKXREAFXKMLRFVKCFLRRRKPFVP

SEQ ID NO: 15 - DNA, 924 bp, Homo sapiens
  CDS (1)..(924)
  variation (80)..(80): r is g or a
  variation (467)..(467): y is c or t
  variation (521)..(521): m is c or a
  variation (564)..(564): r is a or g
  variation (627)..(627): r is a or g
atgctacgtgtagtggaaggcatcttcatttttgttgtagttagtgagtcagtgtttggggttttggggaatggatttattggacttgtaaactgcattgactgtgccaagaataagttrtctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaaygaagaatgacacagtctgggatctcaacatgtataaaagtgaatactttattamacagattttgctaaatctgggagtcattttcttctttacactrtccctaattacatgtatttttttaatcatttccctttggagacacaacaggcagatgcaatcraatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 16 - protein, 307 aa, Homo sapiens
  misc_feature (40)..(40): The 'Xaa' at location 40 stands for Leu.
  misc_feature (156)..(156): The 'Xaa' at location 156 stands for Thr, or Met.
  misc_feature (174)..(174): The 'Xaa' at location 174 stands for Lys, or Thr.
  misc_feature (188)..(188): The 'Xaa' at location 188 stands for Leu.
  misc_feature (209)..(209): The 'Xaa' at location 209 stands for Ser.
MLRVVEGIFIFVVVSESVFGVLGNGFIGLVNCIDCAKNKXSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKXKNDTVWDLNMYKSEYFIXQILLNLGVIFFFTXSLITCIFLIISLWRHNRQMQXNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 17 - DNA, 912 bp, Homo sapiens
  CDS (1)..(912)
  variation (776)..(776): r is a or g
atggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagarcacagtgatctacatgctttgtgagacgattggagtcttctctccttcaagccactcctttcttctgattctaggaaacgctaagttaagacaggcctttcttttggtggcagctaaggtatgggctaaacgatga

SEQ ID NO: 18 - protein, 303 aa, Homo sapiens
  misc_feature (259)..(259): The 'Xaa' at location 259 stands for Ser, or Asn.
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQXTVIYMLCETIGVFSPSSHSFLLILGNAKLRQAFLLVAAKVWAKR

SEQ ID NO: 19 - DNA, 954 bp, Homo sapiens
  CDS (1)..(954)
  variation (256)..(256): r is a or g
atgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttrctaatatctggacagtgatcaatcattttagtgtctggttagctacaggcctcggtactttttattttctcaagatagccaatttttctaactctatttttctctacctaaagtggagrgttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttga

SEQ ID NO: 20 - protein, 317 aa, Homo sapiens
  misc_feature (86)..(86): The 'Xaa' at location 86 stands for Ala, or Thr.
MGGVIKSIFTFVLIVEFIIGNLGNSFIALVNCIDWVKGRKISSVDRILTALAISRISLVWLIFGSWCVSVFFPALFATEKMFRMLXNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 21 - DNA, 876 bp, Homo sapiens
  CDS (1)..(876)
  variation (300)..(300): y is t or c
  variation (301)..(301): r is a or g
  variation (462)..(462): y is t or c
  variation (516)..(516): k is g or t
  variation (665)..(665): r is a or g
  variation (846)..(846): r is a or g
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttacyrtsttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagytactcaccatggagcatctaccaagaaacagcactgtaactgacaaacttgaaaaktttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcrcttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacrttgaaaaggattctaaagggaaagtgctag

SEQ ID NO: 22 - protein, 291 aa, Homo sapiens
  misc_feature (100)..(100): The 'Xaa' at location 100 stands for Thr.
  misc_feature (101)..(101): The 'Xaa' at location 101 stands for Val, Met, or Ile.
  misc_feature (154)..(154): The 'Xaa' at location 154 stands for Leu.
  misc_feature (172)..(172): The 'Xaa' at location 172 stands for Lys, or Asn.
  misc_feature (222)..(222): The 'Xaa' at location 222 stands for Arg, or His.
  misc_feature (282)..(282): The 'Xaa' at location 282 stands for Thr.
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLXXFYCIKVSSFTHHIFLWLRWRILRLFPWILLGSLMITCVTIIPSAIGNYIQIQXLTMEHLPRNSTVTDKLEXFHQYQFQAHTVALVIPFILFLASTIFLMASLTKQIQHHSTGHCNPSMKAXFTALRSLAVLFIVFTSYFLTILITIIGTLFDKRCWLWVWEAFVYAFILMHSTSLMLSSPXLKRILKGKC

SEQ ID NO: 23 - DNA, 1002 bp, Homo sapiens
  CDS (1)..(1002)
  variation (145)..(145): s is c or g
  variation (239)..(239): r is a or g
  variation (785)..(785): y is t or c
  variation (820)..(820): y is t or c
  variation (886)..(886): r is a or g
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcagscactgagcaacagtgattgtgtgctgctgtgtctcagcatcagccggcttttcctgcatggactgctgttcctgagtgctatccagcttacccrcttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagaataaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgytgccttcatctctgtgcccctactgattctgtggygcgacaaaataggggtgatggtttgtgttgggataatggcagcttgtccctctgggcatgcagccrtcctgatctcaggcaatgccaagttgaggagagctgtgatgaccattctgctctgggctcagagcagcctgaaggtaagagccgaccacaaggcagattcccggacactgtgctga

SEQ ID NO: 24 - protein, 333 aa, Homo sapiens
  misc_feature (49)..(49): The 'Xaa' at location 49 stands for Ala, or Pro.
  misc_feature (80)..(80): The 'Xaa' at location 80 stands for Arg, or His.
  misc_feature (262)..(262): The 'Xaa' at location 262 stands for Ala, or Val.
  misc_feature (274)..(274): The 'Xaa' at location 274 stands for Arg, or Cys.
  misc_feature (296)..(296): The 'Xaa' at location 296 stands for Val, or Ile.
MLTLTRIRTVSYEVRSTFLFISVLEFAVGFLTNAFVFLVNFWDVVKRQXLSNSDCVLLCLSISRLFLHGLLFLSAIQLTXFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQNKDLNLFYSFLFCYLWSVPPFLLFLVSSGMLTVSLGRHMRTMKVYTRNSRDPSLEAHIKALKSLVSFFCFFVISSCXAFISVPLLILWXDKIGVMVCVGIMAACPSGHAAXLISGNAKLRRAVMTILLWAQSSLKVRADHKADSRTLC

SEQ ID NO: 25 - DNA, 1014 bp, Homo sapiens
  CDS (1)..(1014)
  variation (578)..(578): y is t or c
  variation (589)..(589): r is a or g
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctycaactccactragaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggagcggcttcagcttcgacttcatctttacccaaaagagtggactctga

SEQ ID NO: 26 - protein, 337 aa, Homo sapiens
  misc_feature (193)..(193): The 'Xaa' at location 193 stands for Ser, or Phe.
  misc_feature (197)..(197): The 'Xaa' at location 197 stands for Glu, or Lys.
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSXNSTXKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWSGFSFDFIFTQKSGL

SEQ ID NO: 27 - DNA, 972 bp, Homo sapiens
  CDS (1)..(972)
  variation (560)..(560): m is a or c
  variation (817)..(817): r is a or g
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctmtgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacrcttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 28 - protein, 323 aa, Homo sapiens
  misc_feature (187)..(187): The 'Xaa' at location 187 stands for Tyr, or Ser.
  misc_feature (273)..(273): The 'Xaa' at location 273 stands for Ala, or Thr.
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFXETNMVNLVFFYNMGIFVPLIMFILAATLLILSLKRHTLHMGSNATGSRDPSMKAHIGAIKATSYFLILYIFNAIALFLSTSNIFDXYSSWNILCKIIMAAYPAGHSVQLILGNPGLRRAWKRFQHQVPLYLKGQTL

SEQ ID NO: 29 - DNA, 924 bp, Homo sapiens
  CDS (1)..(924)
  variation (189)..(189): r is a or g
  variation (380)..(380): y is t or c
  variation (584)..(584): w is a or t
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacrgtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttccyagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgwttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcacagctcctgttgttggcaaggggcttctgggtggcctga

SEQ ID NO: 30 - protein, 307 aa, Homo sapiens
  misc_feature (63)..(63): The 'Xaa' at location 63 stands for Thr.
  misc_feature (127)..(127): The 'Xaa' at location 127 stands for Pro, or Leu.
  misc_feature (195)..(195): The 'Xaa' at location 195 stands for Asp, or Val.
MQAALTAFFVLLFSLLSLLGIAANGFIVLVLGREWLRYGRLLPLDMILISLGASRFCLQLVGXVHNFYYSAQKVEYSGGLGRQFFHLHWHFLNSATFWFCSWLSVLFCVKIANITHSTFLWLKWRFXGWVPWLLLGSVLISFIITLLFFWVNYPVYQEFLIRKFSGNMTYKWNTRIETYYFPSLKLVIWSIPFSXFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 31 - DNA, 930 bp, Homo sapiens
  CDS (1)..(930)
  variation (104)..(104): s is g or c
  variation (270)..(270): r is a or g
  variation (460)..(460): s is g or c
  variation (510)..(510): k is t or g
  variation (599)..(599): k is t or g
  variation (635)..(635): r is a or g
  variation (663)..(663): s is g or c
  variation (882)..(882): k is t or g
  variation (883)..(883): y is t or c
  variation (889)..(889): r is a or g
atgataacttttctacccatcattttttccagtctggtagtggttacatttgttattggaaattttgctaatggcttcatagcactggtaaattccattgagtsgttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtratcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgsggacaaaagaatttgaaggaaacatgacttggaagatcaaattgaagagkgcaatgtacttttcaaatatgactgtaaccatggtagcaaacttagtacccttcactctgaccctactatcttttatgctgttaatctkttctttgtgtaaacatctcaagaagatgcagctccrtggtaaaggatctcaagatcccagcacsaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttkyggcaartgaggtactgggtgaaaggagagaagacttcatctccatga

SEQ ID NO: 32 - protein, 309 aa, Homo sapiens
  misc_feature (35)..(35): The 'Xaa' at location 35 stands for Trp, or Ser.
  misc_feature (90)..(90): The 'Xaa' at location 90 stands for Val.
  misc_feature (154)..(154): The 'Xaa' at location 154 stands for Gly, or Arg.
  misc_feature (170)..(170): The 'Xaa' at location 170 stands for Arg, or Ser.
  misc_feature (200)..(200): The 'Xaa' at location 200 stands for Cys, or Phe.
  misc_feature (212)..(212): The 'Xaa' at location 212 stands for Arg, or His.
  misc_feature (221)..(221): The 'Xaa' at location 221 stands for Thr.
  misc_feature (294)..(294): The 'Xaa' at location 294 stands for Leu, or Phe.
  misc_feature (295)..(295): The 'Xaa' at location 295 stands for Arg, or Trp.
  misc_feature (297)..(297): The 'Xaa' at location 297 stands for Val, or Met.
MITFLPIIFSSLVVVTFVIGNFANGFIALVNSIEXFKRQKISFADQILTALAVSRVGLLWVLLLNWYSTVLNPAFNSVEVRTTAYNIWAXINHFSNWLATTLSIFYLLKIANFSNFIFLHLKRRVKSVILVMLLGPLLFLACHLFVINMNEIVXTKEFEGNMTWKIKLKXAMYFSNMTVTMVANLVPFTLTLLSFMLLIXSLCKHLKKMQLXGKGSQDPSXKVHIKALQTVISFLLLCAIYFLSIMISVWSFGSLENKPVFMFCKAIRFSYPSIHPFILIWGNKKLKQTFLSVXXQXRYWVKGEKTSSP

SEQ ID NO: 33 - DNA, 930 bp, Homo sapiens
  CDS (1)..(930)
  variation (103)..(103): y is t or c
  variation (484)..(484): w is a or t
  variation (599)..(599): r is a or g
  variation (649)..(649): s is g or c
  variation (680)..(680): y is t or c
  variation (718)..(718): r is a or g
  variation (744)..(744): r is a or g
  variation (827)..(827): s is g or c
  variation (843)..(843): r is a or g
atgacaacttttatacccatcattttttccagtgtggtagtggttctatttgttattggaaattttgctaatggcttcatagcattggtaaattccattgagygggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcytgtcaactttttgtgataaacatgaaagagattgtacggacaaaagaatatgaaggaaacwtgacttggaagatcaaattgaggagtgcagtgtacctttcagatgcgactgtaaccacgctaggaaacttagtgcccttcactctgaccctgctatgttttttgctgttaatctrttctctgtgtaaacatctcaagaagatgcagctccatggtaaaggatctsaagatcccagcaccaaggtccacataaaagytttgcaaactgtgatctttttcctcttgttatgtgccrtttactttctgtccataatgatatcrgtttggagttttgggagtctggaaaacaaacctgtcttcatgttctgcaaagctattagattcagctatccttcaatccaccsattcatcctgatttgrggaaacaagaagctaaagcagacttttctttcagttttgcggcaagtgaggtactgggtgaaaggagagaagccttcatctccatga

SEQ ID NO: 34 - protein, 309 aa, Homo sapiens
  misc_feature (35)..(35): The 'Xaa' at location 35 stands for Arg, or Trp.
  misc_feature (162)..(162): The 'Xaa' at location 162 stands for Met, or Leu.
  misc_feature (200)..(200): The 'Xaa' at location 200 stands for Cys, or Tyr.
  misc_feature (217)..(217): The 'Xaa' at location 217 stands for Glu, or Gln.
  misc_feature (227)..(227): The 'Xaa' at location 227 stands for Ala, or Val.
  misc_feature (240)..(240): The 'Xaa' at location 240 stands for Val, or Ile.
  misc_feature (248)..(248): The 'Xaa' at location 248 stands for Ser.
  misc_feature (276)..(276): The 'Xaa' at location 276 stands for Arg, or Pro.
  misc_feature (281)..(281): The 'Xaa' at location 281 stands for Trp.
MTTFIPIIFSSVVVVLFVIGNFANGFIALVNSIEXVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNXTWKIKLRSAVYLSDATVTTLGNLVPFTLTLLCFLLLIXSLCKHLKKMQLHGKGSXDPSTKVHIKXLQTVIFFLLLCAXYFLSIMIXVWSFGSLENKPVFMFCKAIRFSYPSIHXFILIXGNKKLKQTFLSVLRQVRYWVKGEKPSSP

SEQ ID NO: 35 - DNA, 900 bp, Homo sapiens
  CDS (1)..(900)
  variation (106)..(106): k is g or t
  variation (682)..(682): w is a or t
  variation (749)..(749): r is a or g
  variation (862)..(862): y is c or t
atgataacttttctgcccatcattttttccattctaatagtggttacatttgtgattggaaattttgctaatggcttcatagcattggtaaattccattgagtggkttaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctwtgcaaactgtgacctccttcctcttgttatgtgccatttactttctgtccataatcatgtcagtttrgagttttgagagtctggaaaacaaacctgtcttcatgttctgcgaagctattgcattcagctatccttcaacccacccattcatcctgatttggggaaacaagaagctaaagyagacttttctttcagttttgtggcaaatgaggtactga

SEQ ID NO: 36 - protein, 299 aa, Homo sapiens
  misc_feature (36)..(36): The 'Xaa' at location 36 stands for Val, or Phe.
  misc_feature (228)..(228): The 'Xaa' at location 228 stands for Met, or Leu.
  misc_feature (250)..(250): The 'Xaa' at location 250 stands for Trp.
  misc_feature (288)..(288): The 'Xaa' at location 288 stands for Gln.
MITFLPIIFSILIVVTFVIGNFANGFIALVNSIEWXKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKAXQTVTSFLLLCAIYFLSIIMSVXSFESLENKPVFMFCEAIAFSYPSTHPFILIWGNKKLKXTFLSVLWQMRY

SEQ ID NO: 37 - DNA, 929 bp, Homo sapiens
  CDS (1)..(927)
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatga

SEQ ID NO: 38 - protein, 309 aa, Homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNFGRLEKQPVFMFCQAIIFSYPSTHPFILILGNKKLKQIFLSVLRHVRYWVKDRSLRLH

SEQ ID NO: 39 - DNA, 900 bp, Homo sapiens
  CDS (1)..(900)
  variation (94)..(94): r is a or g
  variation (326)..(326): m is a or c
  variation (418)..(418): y is t or c
  variation (456)..(456): w is a or t
  variation (673)..(673): r is a or g
  variation (719)..(719): y is t or c
  variation (799)..(799): s is g or c
  variation (883)..(883): r is a or g
  variation (895)..(895): y is t or c
atgatgtgttttctgctcatcatttcatcaattctggtagtgtttgcatttgttcttggaaatgttgccaatggcttcatagcyctagtaaatrtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcamgattgccaatttctccaaccttatttctctccacctaaagaagagaattaagagtgttgttctggtgatactgttggggcccttggtatttytgatttgtaatcttgctgtgataaccatggatgagagwgtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatrtaaaagctttgcaaactgtgacctccttcctcatgttatttgccayttactttctgtgtataatcacatcaacttggaatcttaggacacagcagagcaaacttgtactcctgctttgccaaactsttgcaatcatgtatccttcattccactcattcatcctgattatgggaagtaggaagctaaaacagacctttctttcagttttgtgrcagatgacaygctga

SEQ ID NO: 40 - protein, 299 aa, Homo sapiens
  misc_feature (32)..(32): The 'Xaa' at location 32 stands for Val, or Ile.
  misc_feature (109)..(109): The 'Xaa' at location 109 stands for Lys, or Thr.
  misc_feature (140)..(140): The 'Xaa' at location 140 stands for Leu.
  misc_feature (152)..(152): The 'Xaa' at location 152 stands for Arg, or Ser.
  misc_feature (225)..(225): The 'Xaa' at location 225 stands for Val, or Ile.
  misc_feature (240)..(240): The 'Xaa' at location 240 stands for Thr, or Ile.
  misc_feature (267)..(267): The 'Xaa' at location 267 stands for Val, or Leu.
  misc_feature (295)..(295): The 'Xaa' at location 295 stands for Trp.
  misc_feature (299)..(299): The 'Xaa' at location 299 stands for Arg, or Cys.
MMCFLLIISSILVVFAFVLGNVANGFIALVNXIDWVNTRKISSAEQILTALVVSRIGLLWVMLFLWYATVFNSALYGLEVRIVASNAWAVTNHFSMWLAASLSIFCLLXIANFSNLISLHLKKRIKSVVLVILLGPLVFXICNLAVITMDEXVWTKEYEGNVTWKIKLRNAIHLSSLTVTTLANLIPFTLSLICFLLLICSLCKHLKKMRLHSKGSQDPSTKVHXKALQTVTSFLMLFAXYFLCIITSTWNLRTQQSKLVLLLCQTXAIMYPSFHSFILIMGSRKLKQTFLSVLXQMTX

SEQ ID NO: 41 - DNA, 930 bp, Homo sapiens
  CDS (1)..(930)
  variation (421)..(421): r is a or g
  variation (429)..(429): m is a or c
  variation (442)..(442): m is a or c
  variation (516)..(516): r is a or g
  variation (706)..(706): r is a or g
  variation (755)..(755): y is t or c
  variation (764)..(764): k is g or t
  variation (808)..(808): r is a or g
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcrgtctccaaagttggtttgctctgggtaatattattacattggtattcaactgtgttgaatccaacttcatctaatttaaaagtaataatttttatttctaatgcytgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttgrtttgtcamcttgtgatgaaamacacgtatataaatgtgtggacagaagaatgtgaaggaaacgtaacttggaagatcaaactgaggaatgcaatrcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcrtattacttgccatttactttctgtgtctaatcatatcgttttggaattytaagatgckaccaaaagaaattgtcttaatgctttgccaagcttttggaatcrtatatccatcattccactcattcattctgatttgggggaacaagacgctaaagcagacctttctttcagttttgtggcaggtgacttgctgggcaaaaggacagaaccagtcaactccatag

SEQ ID NO: 42 - protein, 309 aa, Homo sapiens
  misc_feature (141)..(141): The 'Xaa' at location 141 stands for Val, or Ile.
  misc_feature (143)..(143): The 'Xaa' at location 143 stands for Gln, or His.
  misc_feature (148)..(148): The 'Xaa' at location 148 stands for Asn, or His.
  misc_feature (172)..(172): The 'Xaa' at location 172 stands for Met, or Ile.
  misc_feature (236)..(236): The 'Xaa' at location 236 stands for Val, or Ile.
  misc_feature (252)..(252): The 'Xaa' at location 252 stands for Ser, or Phe.
  misc_feature (255)..(255): The 'Xaa' at location 255 stands for Arg, or Leu.
  misc_feature (270)..(270): The 'Xaa' at location 270 stands for Val, or Ile.
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLXCXLVMKXTYINVWTEECEGNVTWKIKLRNAXHLSNLTVAMLANLIPFTLTLISFLLLIYSLCKHLKKMQLHGKGSQDPSTKIHIKALQTVTSFLXLLAIYFLCLIISFWNXKMXPKEIVLMLCQAFGIXYPSFHSFILIWGNKTLKQTFLSVLWQVTCWAKGQNQSTP

SEQ ID NO: 43 - DNA, 900 bp, Homo sapiens
  CDS (1)..(900)
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtataaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccagttgtcatggttagcaaggctgttggaaacatatatcttgcattcgactcattcatcctaatttggagaaccaagaagctaaaacacacctttcttttgattttgtgtcagattaggtgctga

SEQ ID NO: 44 - protein, 299 aa, Homo sapiens
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLYKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 45 - DNA, 957 bp, Homo sapiens
  CDS (1)..(957)
  variation (595)..(595): w is a or t
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaawtgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgycgttcctcaaggtgtgggacaccttga

SEQ ID NO: 46 - protein, 318 aa, Homo sapiens
  misc_feature (199)..(199): The 'Xaa' at location 199 stands for Met, or Leu.
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKXITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 47 - DNA, 900 bp, homo sapiens
  CDS (1)..(900)
  variation (332)..(332): SNP
  variation (616)..(616): SNP
atgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 48 - protein, 299 aa, homo sapiens
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 49 - DNA, 900 bp, homo sapiens
  CDS (1)..(900)
  variation (332)..(332): SNP
  variation (616)..(616): SNP
atgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacctggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 50 - protein, 299 aa, homo sapiens [sequence omitted]

SEQ ID NO: 51 - DNA, 900 bp, homo sapiens
  CDS (1)..(900)
  variation (332)..(332): SNP
  variation (616)..(616): SNP
atgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccatcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 52 - protein, 299 aa, homo sapiens [sequence omitted]

SEQ ID NO: 53 - DNA, 951 bp, homo sapiens
  CDS (1)..(951)
  variation (349)..(349): SNP
atgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcaccccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttag

SEQ ID NO: 54 - protein, 316 aa, homo sapiens
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 55 - DNA, 951 bp, homo sapiens
  CDS (1)..(951)
  variation (349)..(349): SNP
atgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcactccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttag

SEQ ID NO: 56 - protein, 316 aa, homo sapiens
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHSTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 57 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 58 - protein, 299 aa, homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSLWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 59 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcaatgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 60 - protein, 299 aa, homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSLWFVTLLNILYCVKITNFQHSVFLLLKRNISPKIPRLLLACVLISAFTTCLYITLSQASPFPELVTTRNNTSFNINEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 61 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtgtctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 62 - protein, 299 aa, homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 63 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactattactggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 64 - protein, 299 aa, homo sapiens
MLRLFYFSAIIASVILNFVGIIMNLFITVVNCKTWVKSHRISSSDRILFSLGITRFLMLGLLLVNTIYFVSSNTERSVYLSAFFVLCFMFLDSSSLWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 65 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctattcctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcaatgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 66 - protein, 299 aa, homo sapiens [sequence omitted]

SEQ ID NO: 67 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcggttattctattcctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatatggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcaatgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 68 - protein, 299 aa, homo sapiens
MLRLFYSSAIIASVILNFVGIIMNLFITVVNCKTWVKSHRISSSDRILFSLGITRFLMLGLFLVNTIYFVSSNMERSVYLSAFFVLCFMFLDSSSLWFVTLLNILYCVKITNFQHSVFLLLKRNISPKIPRLLLACVLISAFTTCLYITLSQASPFPELVTTRNNTSFNINEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 69 - DNA, 900 bp, homo sapiens
  CDS (1)..(900)
  variation (8)..(8): SNP
  variation (20)..(20): SNP
  variation (186)..(186): SNP
  variation (221)..(221): SNP
  variation (286)..(286): SNP
  variation (512)..(512): SNP
atgcttcggttattctcttcctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcaatgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 70 - protein, 299 aa, homo sapiens
MLRLFSSSAIIASVILNFVGIIMNLFITVVNCKTWVKSHRISSSDRILFSLGITRFLMLGLFLVNTIYFVSSNTERSVYLSAFFVLCFMFLDSSSLWFVTLLNILYCVKITNFQHSVFLLLKRNISPKIPRLLLACVLISAFTTCLYITLSQASPFPELVTTRNNTSFNINEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 71 - DNA, 900 bp, homo sapiens
  CDS (1)..(900)
  variation (8)..(8): SNP
  variation (17)..(17): SNP
  variation (20)..(20): SNP
  variation (186)..(186): SNP
  variation (221)..(221): SNP
  variation (286)..(286): SNP
  variation (512)..(512): SNP
atgcttcagttattctattcctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtctctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcaatgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatag

SEQ ID NO: 72 - protein, 299 aa, homo sapiens
MLQLFYSSAIIASVILNFVGIIMNLFITVVNCKTWVKSHRISSSDRILFSLGITRFLMLGLFLVNTIYFVSSNTERSVYLSAFFVLCFMFLDSSSLWFVTLLNILYCVKITNFQHSVFLLLKRNISPKIPRLLLACVLISAFTTCLYITLSQASPFPELVTTRNNTSFNINEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 73 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 74 - protein, 299 aa, homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 75 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccaggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 76 - protein, 299 aa, homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVQAKAHITALKSLGCFLLLHLVYIMASPFSITSKTYPPDLTSVFIWETLMAAYPSLHSLILIMGIPRVKQTCQKILWKTVCARRCWGP

SEQ ID NO: 77 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtgcctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 78 - protein, 299 aa, homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQCLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 79 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcctggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 80 - protein, 299 aa, homo sapiens
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRLAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 81 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaatcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 82 - protein, 299 aa, homo sapiens [sequence omitted]

SEQ ID NO: 83 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (871)..(871): SNP
  variation (881)..(881): SNP
atgctgagcgctggcctaggactgctgatgctggtggcagtggttgaatttctcatcggtttaattggaaatggaatcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctctgagatgctggggcccatga

SEQ ID NO: 84 - protein, 299 aa, homo sapiens
MLSAGLGLLMLVAVVEFLIGLIGNGILVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCALRCWGP

SEQ ID NO: 85 - DNA, 900 bp, homo sapiens
  CDS (1)..(900)
  variation (77)..(77): SNP
  variation (235)..(235): SNP
  variation (338)..(338): SNP
  variation (500)..(500): SNP
  variation (638)..(638): SNP
  variation (881)..(881): SNP
atgctgagcgctggcctaggactgctgatgctggtggcagtggttgaatttctcatcggtttaattggaaatggaatcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggctttgctatcttagtatcttctgggtcctggtaagccaggccagcttatggtttgccaccttcctcagtgtcttctattgcaagaagatcacgaccttcgatcgcctggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatga

SEQ ID NO: 86 - protein, 299 aa, homo sapiens
MLSAGLGLLMLVAVVEFLIGLIGNGILVVWSFREWIRKFNWSSYNLIILGLAGCRFLLQWLIILDLSLFPLFQSSRWLCYLSIFWVLVSQASLWFATFLSVFYCKKITTFDRLAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 87 - DNA, 957 bp, homo sapiens
  CDS (1)..(957)
  variation (254)..(254): SNP
  variation (538)..(538): SNP
  variation (640)..(640): SNP
  variation (787)..(787): SNP
  variation (788)..(788): SNP
  variation (912)..(912): SNP
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctga

SEQ ID NO: 88 - protein, 318 aa, homo sapiens
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPETELAVIFGESIALIYPSSHSFILILGNNKLRHASLKVIWKVMSILKGRKFQQHKQI

SEQ ID NO: 89 - DNA, 957 bp, homo sapiens
  CDS (1)..(957)
  variation (254)..(254): SNP
  variation (538)..(538): SNP
  variation (640)..(640): SNP
  variation (787)..(787): SNP
  variation (788)..(788): SNP
  variation (912)..(912): SNP
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatatctattctaaaaggaagaaaattccaacaacataaacaaatctga

SEQ ID NO: 90 - protein, 318 aa, homo sapiens [sequence omitted]

SEQ ID NO: 91 - DNA, 957 bp, homo sapiens
  CDS (1)..(957)
  variation (254)..(254): SNP
  variation (538)..(538): SNP
  variation (640)..(640): SNP
  variation (787)..(787): SNP
  variation (788)..(788): SNP
  variation (912)..(912): SNP
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagatggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctga

SEQ ID NO: 92 - protein, 318 aa, homo sapiens
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPEMELAVIFGESIALIYPSSHSFILILGNNKLRHASLKVIWKVMSILKGRKFQQHKQI

SEQ ID NO: 93 - DNA, 957 bp, homo sapiens
  CDS (1)..(642)
  variation (254)..(254): SNP
  variation (538)..(538): SNP
  variation (640)..(640): SNP
  variation (787)..(787): SNP
  variation (788)..(788): SNP
  variation (912)..(912): SNP
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggtgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatatctattctaaaaggaagaaaattccaacaacataaacaaatctga

SEQ ID NO: 94 - protein, 213 aa, homo sapiens [sequence omitted]

SEQ ID NO: 95 - DNA, 957 bp, homo sapiens
  CDS (1)..(957)
  variation (254)..(254): SNP
  variation (538)..(538): SNP
  variation (640)..(640): SNP
  variation (787)..(787): SNP
  variation (788)..(788): SNP
  variation (912)..(912): SNP
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcactgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacattcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagtcggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctga

SEQ ID NO: 96 - protein, 318 aa, homo sapiens [sequence omitted]

SEQ ID NO: 97 - DNA, 930 bp, homo sapiens
  CDS (1)..(930)
  variation (142)..(142): SNP
  variation (370)..(370): SNP
  variation (496)..(496): SNP
  variation (829)..(829): SNP
  variation (922)..(922): SNP
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcatgatatga

SEQ ID NO: 98 - protein, 309 aa, homo sapiens
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACMI

SEQ ID NO: 99 - DNA, 930 bp, homo sapiens
  CDS (1)..(930)
  variation (142)..(142): SNP
  variation (370)..(370): SNP
  variation (496)..(496): SNP
  variation (829)..(829): SNP
  variation (922)..(922): SNP
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcgtgatatga

SEQ ID NO: 100 - protein, 309 aa, homo sapiens
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACVI

SEQ ID NO: 101 - DNA, 930 bp, homo sapiens
  CDS (1)..(930)
  variation (142)..(142): SNP
  variation (370)..(370): SNP
  variation (496)..(496): SNP
  variation (829)..(829): SNP
  variation (922)..(922): SNP
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctccaccccttgggtcactcacttattttaattgttttaaataataaactgaggcagacatttgtcagaatgctgacatgtagaaaaattgcctgcatgatatga

SEQ ID NO: 102 - protein, 309 aa, homo sapiens [sequence omitted]

SEQ ID NO: 103 - DNA, 930 bp, homo sapiens
  CDS (1)..(930)
  variation (142)..(142): SNP
  variation (370)..(370): SNP
  variation (496)..(496): SNP
  variation (829)..(829): SNP
  variation (922)..(922): SNP
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaggaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcgtgatatga

SEQ ID NO: 104 - protein, 309 aa, homo sapiens
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKGNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACVI

SEQ ID NO: 105 - DNA, 930 bp, homo sapiens
  CDS (1)..(930)
  variation (142)..(142)
  variation (370)..(370)
  variation (496)..(496)
  variation (829)..(829)
  variation (922)..(922)
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaaggggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcgtgatatga

SEQ ID NO: 106 - protein, 309 aa, homo sapiens
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKGKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACVI

SEQ ID NO: 107 - DNA, 930 bp, homo sapiens
  CDS (1)..(930)
  variation (142)..(142)
  variation (370)..(370)
  variation (496)..(496)
  variation (829)..(829)
  variation (922)..(922)
atgttcagtcctgcagataacatctttataatcctaataactggagaattcatactaggaatattggggaatggatacattgcactagtcaactggattgactggattaagaagaaaaagatttccacagttgactacatctttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcgtgatatga

SEQ ID NO: 108 - protein, 309 aa, homo sapiens [sequence omitted]

SEQ ID NO: 109 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 110 - protein, 312 aa, homo sapiens
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 111 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttatgaagatgttaagatttgtgaagtgtttccttagaagaagaaagccttttgttccatag

SEQ ID NO: 112 - protein, 312 aa, homo sapiens
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFMKMLRFVKCFLRRRKPFVP

SEQ ID NO: 113 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagtttagggaagcttttctgaagatgttaagatttgtgaagtgtttccttagaagaagaaagccttttgttccatag

SEQ ID NO: 114 - protein, 312 aa, homo sapiens
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKFREAFLKMLRFVKCFLRRRKPFVP

SEQ ID NO: 115 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggcgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 116 - protein, 312 aa, homo sapiens [sequence omitted]

SEQ ID NO: 117 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggcgatggttccctttatcctttgcctgatctcatttttcttgttacttttctccctagttagacacaccaagcagattcgactgcatgctacagggttcagagaccccagtacagaggcccacatgagggccataaagacagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 118 - protein, 312 aa, homo sapiens [sequence omitted]

SEQ ID NO: 119 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgaagatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 120 - protein, 312 aa, homo sapiens [sequence omitted]

SEQ ID NO: 121 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaaaaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 122 - protein, 312 aa, homo sapiens
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKIKKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 123 - DNA, 939 bp, homo sapiens
  CDS (1)..(939)
  variation (201)..(201): SNP
  variation (381)..(381): SNP
  variation (450)..(450): SNP
  variation (560)..(560): SNP
  variation (697)..(697): SNP
  variation (867)..(867): SNP
  variation (880)..(880): SNP
atgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttatttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 124 - protein, 312 aa, homo sapiens [sequence omitted]

SEQ ID NO: 125 - DNA, 924 bp, homo sapiens
  CDS (1)..(924)
  variation (467)..(467): SNP
  variation (521)..(521): SNP
  variation (691)..(691): SNP
atgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 126 - protein, 307 aa, homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKMKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 127 - DNA, 924 bp, homo sapiens
  CDS (1)..(924)
  variation (467)..(467): SNP
  variation (521)..(521): SNP
  variation (691)..(691): SNP
atgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatacctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 128 - protein, 307 aa, homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKMKNDTVWDLNMYKSEYFIKQILLNLGVIFFFTLSLITCIFLIISLWRHNRQMQSNVTGLRDSNTEAHVKAMKVLIPFIILFILYFIGMAIEISCFTVRENKLLLMFGMTTTAIYPWGHSFILILGNSKLKQASLRVLQQLKCCEKRKNLRVT

SEQ ID NO: 129 - DNA, 924 bp, homo sapiens
  CDS (1)..(924)
  variation (467)..(467)
  variation (521)..(521)
  variation (691)..(691)
atgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattacacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 130 - protein, 307 aa, homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKMKNDTVWDLNMYKSEYFITQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 131 - DNA, 924 bp, homo sapiens
  CDS (1)..(924)
  variation (467)..(467): SNP
  variation (521)..(521): SNP
  variation (691)..(691): SNP
atgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaacgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatag

SEQ ID NO: 132 - protein, 307 aa, homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 133 - DNA, 912 bp, homo sapiens
  CDS (1)..(912)
  variation (776)..(776): SNP
atggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagaacacagtgatctacatgctttgtgagacgattggagtcttctctccttcaagccactcctttcttctgattctaggaaacgctaagttaagacaggcctttcttttggtggcagctaaggtatgggctaaacgatga

SEQ ID NO: 134 - protein, 303 aa, homo sapiens
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQNTVIYMLCETIGVFSPSSHSFLLILGNAKLRQAFLLVAAKVWAKR

SEQ ID NO: 135 - DNA, 912 bp, homo sapiens
  CDS (1)..(912)
  variation (776)..(776): SNP
atggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagagcacagtgatctacatgctttgtgagacgattggagtcttctctccttcaagccactcctttcttctgattctaggaaacgctaagttaagacaggcctttcttttggtggcagctaaggtatgggctaaacgatga

SEQ ID NO: 136 - protein, 303 aa, homo sapiens [sequence omitted]

SEQ ID NO: 137 - DNA, 954 bp, homo sapiens
  CDS (1)..(954)
  variation (256)..(256): SNP
  variation (589)..(589): SNP
atgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttga

SEQ ID NO: 138 - protein, 317 aa, homo sapiens
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 139 - DNA, 954 bp, homo sapiens
  CDS (1)..(954)
  variation (256)..(256): SNP
  variation (589)..(589): SNP
atgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcagtgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttga

SEQ ID NO: 140 - protein, 317 aa, homo sapiens
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAVFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 141 - DNA, 954 bp, homo sapiens
  CDS (1)..(954)
  variation (256)..(256): SNP
  variation (589)..(589): SNP
atgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttgctaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttga

SEQ ID NO: 142 - protein, 317 aa, homo sapiens
MGGVIKSIFTFVLIVEFIIGNLGNSFIALVNCIDWVKGRKISSVDRILTALAISRISLVWLIFGSWCVSVFFPALFATEKMFRMLANIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 143 - DNA, 876 bp, homo sapiens
  CDS (1)..(876)
  variation (301)..(301): SNP
  variation (481)..(481): SNP
  variation (516)..(516): SNP
  variation (665)..(665): SNP
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 144 - protein, 291 aa, homo sapiens
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKAHFTALRSLAVLFIVFTSYFLTILITIIGTLFDKRCWLWVWEAFVYAFILMHSTSLMLSSPTLKRILKGKC

SEQ ID NO: 145 - DNA, 876 bp, homo sapiens
  CDS (1)..(876)
  variation (301)..(301): SNP
  variation (481)..(481): SNP
  variation (516)..(516): SNP
  variation (665)..(665): SNP
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcgcttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 146 - protein, 291 aa, homo sapiens
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKARFTALRSLAVLFIVFTSYFLTILITIIGTLFDKRCWLWVWEAFVYAFILMHSTSLMLSSPTLKRILKGKC

SEQ ID NO: 147 - DNA, 876 bp, homo sapiens
  CDS (1)..(876)
  variation (301)..(301): SNP
  variation (481)..(481): SNP
  variation (516)..(516): SNP
  variation (665)..(665): SNP
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaagtttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 148 - protein, 291 aa, homo sapiens [sequence omitted]

SEQ ID NO: 149 - DNA, 876 bp, homo sapiens
  CDS (1)..(876)
  variation (301)..(301): SNP
  variation (481)..(481): SNP
  variation (516)..(516): SNP
  variation (665)..(665): SNP
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctatcaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 150 - protein, 291 aa, homo sapiens [sequence omitted]

SEQ ID NO: 151 - DNA, 876 bp, homo sapiens
  CDS (1)..(876)
  variation (301)..(301): SNP
  variation (481)..(481): SNP
  variation (516)..(516): SNP
  variation (665)..(665): SNP
atgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccatgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctag

SEQ ID NO: 152 - protein, 291 aa, homo sapiens [sequence omitted]

SEQ ID NO: 153 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcagccactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccgtcctgatctcaggcaatgccaagttgaggagagctgtgatgaccattctgctctgggctcagagcagcctgaaggtaagagccgaccacaaggcagattcccggacactgtgctga

SEQ ID NO: 154 - protein, 333 aa, homo sapiens [sequence omitted]

SEQ ID NO: 155 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcagccactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgttgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctga

SEQ ID NO: 156 - protein, 333 aa, homo sapiens [sequence omitted]

SEQ ID NO: 157 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccgcttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctga

SEQ ID NO: 158 - protein, 333 aa, homo sapiens
MLTLTRIRTVSYEVRSTFLFISVLEFAVGFLTNAFVFLVNFWDVVKRQALSNSDCVLLCLSISRLFLHGLLFLSAIQLTRFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWRDKIGVMVCVGIMAACPSGHAAILISGNAKLRRAVMTILLWAQSSLKVRADHKADSRTLC

SEQ ID NO: 159 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctga

SEQ ID NO: 160 - protein, 333 aa, homo sapiens
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWRDKIGVMVCVGIMAACPSGHAAILISGNAKLRRAVMTILLWAQSSLKVRADHKADSRTLC

SEQ ID NO: 161 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccgtcctgatctcaggcaatgccaagttgaggagagctgtgatgaccattctgctctgggctcagagcagcctgaaggtaagagccgaccacaaggcagattcccggacactgtgctga

SEQ ID NO: 162 - protein, 333 aa, homo sapiens [sequence omitted]

SEQ ID NO: 163 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggtgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctga

SEQ ID NO: 164 - protein, 333 aa, homo sapiens
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWCDKIGVMVCVGIMAACPSGHAAILISGNAKLRRAVMTILLWAQSSLKVRADHKADSRTLC

SEQ ID NO: 165 - DNA, 1002 bp, homo sapiens
  CDS (1)..(1002)
  variation (145)..(145): SNP
  variation (239)..(239): SNP
  variation (785)..(785): SNP
  variation (820)..(820): SNP
  variation (886)..(886): SNP
atgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgttgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctga

SEQ ID NO: 166 - protein, 333 aa, homo sapiens
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCVAFISVPLLILWRDKIGVMVCVGIMAACPSGHAAILISGNAKLRRAVMTILLWAQSSLKVRADHKADSRTLC

SEQ ID NO: 167 - DNA, 1017 bp, homo sapiens
  CDS (1)..(1017)
  variation (578)..(578): SNP
  variation (589)..(589): SNP
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctccaactccactaagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggaagcggcttcagcttcgacttcatctttacccaaaagagtggactctgtga

SEQ ID NO: 168 - protein, 338 aa, homo sapiens
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSSNSTKKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWKRLQLRLHLYPKEWTL

SEQ ID NO: 169 - DNA, 1017 bp, homo sapiens
  CDS (1)..(1017)
  variation (578)..(578): SNP
  variation (589)..(589): SNP
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactccttcaactccactgagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggaagcggcttcagcttcgacttcatctttacccaaaagagtggactctgtga

SEQ ID NO: 170 - protein, 338 aa, homo sapiens
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSFNSTEKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWKRLQLRLHLYPKEWTL

SEQ ID NO: 171 - DNA, 972 bp, homo sapiens
  CDS (1)..(972)
  variation (560)..(560): SNP
  variation (817)..(817): SNP
  variation (871)..(871): SNP
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 172 - protein, 323 aa, homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 173 - DNA, 972 bp, homo sapiens
  CDS (1)..(972)
  variation (560)..(560): SNP
  variation (817)..(817): SNP
  variation (871)..(871): SNP
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccagccactcagtacaactgatcttgggcaaccctgggctgagaagagcctggaagcggtttcagcaccaagttcctctttacctaaaagggcagactctgtga

SEQ ID NO: 174 - protein, 323 aa, homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPASHSVQLILGNPGLRRAWKRFQHQVPLYLKGQTL

SEQ ID NO: 175 - DNA, 972 bp, homo sapiens
  CDS (1)..(972)
  variation (560)..(560): SNP
  variation (817)..(817): SNP
  variation (871)..(871): SNP
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacgcttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 176 - protein, 323 aa, homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDAYSSWNILCKIIMAAYPAGHSVQLILGNPGLRRAWKRFQHQVPLYLKGQTL

SEQ ID NO: 177 - DNA, 972 bp, homo sapiens
  CDS (1)..(972)
  variation (560)..(560): SNP
  variation (817)..(817): SNP
  variation (871)..(871): SNP
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctatgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 178 - protein, 323 aa, homo sapiens [sequence omitted]

SEQ ID NO: 179 - DNA, 972 bp, homo sapiens
  CDS (1)..(972)
  variation (560)..(560): SNP
  variation (817)..(817): SNP
  variation (871)..(871): SNP
atggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctatgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacgcttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtga

SEQ ID NO: 180 - protein, 323 aa, homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFYETNMVNLVFFYNMGIFVPLIMFILAATLLILSLKRHTLHMGSNATGSRDPSMKAHIGAIKATSYFLILYIFNAIALFLSTSNIFDAYSSWNILCKIIMAAYPAGHSVQLILGNPGLRRAWKRFQHQVPLYLKGQTL

SEQ ID NO: 181 - DNA, 924 bp, homo sapiens
  CDS (1)..(924)
  variation (380)..(380): SNP
  variation (584)..(584): SNP
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacagtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcccagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgtttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcacagctcctgttgttggcaaggggcttctgggtggcctga

SEQ ID NO: 182 - protein, 307 aa, homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 183 - DNA, 924 bp, homo sapiens
  CDS (1)..(924)
  variation (380)..(380): SNP
  variation (584)..(584): SNP
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacagtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcccagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgattttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcacagctcctgttgttggcaaggggcttctgggtggcctga

SEQ ID NO: 184 - protein, 307 aa, homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGSVLISFIITLLFFWVNYPVYQEFLIRKFSGNMTYKWNTRIETYYFPSLKLVIWSIPFSDFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 185 - DNA, 924 bp, homo sapiens
  CDS (1)..(924)
  variation (380)..(380): SNP
  variation (584)..(584): SNP
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacagtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcctagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgtttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcacagctcctgttgttggcaaggggcttctgggtggcctga

SEQ ID NO: 186 - protein, 307 aa, homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFLGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 187 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagtgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagttttgcaaactgtgatctttttcctcttgttatgtgccatttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatga

SEQ ID NO: 188 - protein, 309 aa, homo sapiens
MTTFIPIIFSSVVVVLFVIGNFANGFIALVNSIEWVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNMTWKIKLRSAVYLSDATVTTLGNLVPFTLTLLCFLLLICSLCKHLKKMQLHGKGSQDPSTKVHIKVLQTVIFFLLLCAIYFLSIMISVWSFGSLENKPVFMFCKAIRFSYPSIHPFILIWGNKKLKQTFLSVLRQVRYWVKGEKPSSP

SEQ ID NO: 189 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagtgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctgaagatcccagcaccaaggtccacataaaagttttgcaaactgtgatctttttcctcttgttatgtgccatttactttctgtccataatgatatcagtttggagttttgggagtctggaaaacaaacctgtcttcatgttctgcaaagctattagattcagctatccttcaatccaccgattcatcctgatttggggaaacaagaagctaaagcagacttttctttcagttttgcggcaagtgaggtactgggtgaaaggagagaagccttcatctccatga

SEQ ID NO: 190 - protein, 309 aa, homo sapiens [sequence omitted]

SEQ ID NO: 191 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagttttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttgtggaaacaagaagctaaagcagacttttctttcagttttgcggcaagtgaggtactgggtgaaaggagagaagccttcatctccatga

SEQ ID NO: 192 - protein, 309 aa, homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNMTWKIKLRSAVYLSDATVTTLGNLVPFTLTLLCFLLLICSLCKHLKKMQLHGKGSQDPSTKVHIKVLQTVIFFLLLCAVYFLSIMISVWSFGSLENKPVFMFCKAIRFSYPSIHPFILICGNKKLKQTFLSVLRQVRYWVKGEKPSSP

SEQ ID NO: 193 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatga

SEQ ID NO: 194 - protein, 309 aa, homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNMTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 195 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatga

SEQ ID NO: 196 - protein, 309 aa, homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 197 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatctcagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatga

SEQ ID NO: 198 - protein, 309 aa, homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDLSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 199 - DNA, 930 bp, homo sapiens
  CDS (1)..(930)
  variation (103)..(103): SNP
  variation (484)..(484): SNP
  variation (599)..(599): SNP
  variation (649)..(649): SNP
  variation (656)..(656): SNP
  variation (680)..(680): SNP
  variation (718)..(718): SNP
  variation (827)..(827): SNP
  variation (843)..(843): SNP
atgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctattctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatga

SEQ ID NO: 200 - protein, 309 aa, homo sapiens
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLIYSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 201 - DNA, 930 bp, homo sapiens
  CDS (1)..(750)
  variation (106)..(106): SNP
  variation (682)..(682): SNP
  variation (749)..(749): SNP
  variation (862)..(862): SNP
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttagagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 202 - protein, 249 aa, homo sapiens
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKAMQTVTSFLLLCAIYFLSIIMSV

SEQ ID NO: 203 - DNA, 930 bp, homo sapiens
  CDS (1)..(750)
  variation (106)..(106): SNP
  variation (682)..(682): SNP
  variation (749)..(749): SNP
  variation (834)..(834): SNP
  variation (862)..(862): SNP
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttagagttttgagagtctggaaaacaaacctgtcttcatgttctgcgaagctattgcattcagctatccttcaacccacccattcatgctgatttggggaaacaagaagctaaagcagacttttctttcagttttgtggcatgtgaggtactgggtgaaaggagagaagccttcatcttcatag

SEQ ID NO: 204 - protein, 249 aa, homo sapiens; identical to SEQ ID NO: 202

SEQ ID NO: 205 - DNA, 930 bp, homo sapiens
  CDS (1)..(930)
  variation (106)..(106): SNP
  variation (682)..(682): SNP
  variation (749)..(749): SNP
  variation (834)..(834): SNP
  variation (862)..(862): SNP
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 206 - protein, 309 aa, homo sapiens [sequence omitted]

SEQ ID NO: 207 - DNA, 930 bp, homo sapiens
  CDS (1)..(930)
  variation (106)..(106): SNP
  variation (682)..(682): SNP
  variation (749)..(749): SNP
  variation (834)..(834): SNP
  variation (862)..(862): SNP
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctttgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 208 - protein, 309 aa, homo sapiens
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLKQTFLSVLWHVRYWVKGEKPSSS

SEQ ID NO: 209 - DNA, 930 bp, homo sapiens
  CDS (1)..(864)
  variation (106)..(106): SNP
  variation (682)..(682): SNP
  variation (749)..(749): SNP
  variation (834)..(834): SNP
  variation (862)..(862): SNP
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctttgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagtagacttttctttcagttttgtggcatgtgaggtactgggtgaaaggagagaagccttcatcttcatag

SEQ ID NO: 210 - protein, 287 aa, homo sapiens
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLK

SEQ ID NO: 211 - DNA, 930 bp, homo sapiens
  CDS (1)..(750)
  variation (106)..(106): SNP
  variation (682)..(682): SNP
  variation (749)..(749): SNP
  variation (834)..(834): SNP
  variation (862)..(862): SNP
atgataacttttctgcccatcattttttccattctaatagtggttacatttgtgattggaaattttgctaatggcttcatagcattggtaaattccattgagtgggtcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttagagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 212 - protein, 249 aa, homo sapiens
MITFLPIIFSILIVVTFVIGNFANGFIALVNSIEWVKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKAMQTVTSFLLLCAIYFLSIIMSV

SEQ ID NO: 213 - DNA, 960 bp, homo sapiens
  CDS (1)..(960)
  variation (521)..(521): SNP
  variation (577)..(577): SNP
  variation (756)..(756): SNP
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaatttggggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctag

SEQ ID NO: 214 - protein, 319 aa, homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNLGRLEKQPVFMFCQAIIFSYPSTHPFILILGNKKLKQIFLSVLRHVRYWVKDRSLRLHRFTRGALCVF

SEQ ID NO: 215 - DNA, 960 bp, homo sapiens
  CDS (1)..(960)
  variation (521)..(521): SNP
  variation (577)..(577): SNP
  variation (756)..(756): SNP
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctag

SEQ ID NO: 216 - protein, 319 aa, homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLISFLLLICSLCKHLKKMQLHGKGSQDPSTKVHIKALQTVTSFLLLCAIYFLSMIISVCNFGRLEKQPVFMFCQAIIFSYPSTHPFILILGNKKLKQIFLSVLRHVRYWVKDRSLRLHRFTRGALCVF

SEQ ID NO: 217 - DNA, 960 bp, homo sapiens
  CDS (1)..(960)
  variation (521)..(521): SNP
  variation (577)..(577): SNP
  variation (756)..(756): SNP
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctggtatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaatttggggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctag

SEQ ID NO: 218 - protein, 319 aa, homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYHSNMTLTMLANFVPLTLTLVSFLLLICSLCKHLKKMQLHGKGSQDPSTKVHIKALQTVTSFLLLCAIYFLSMIISVCNLGRLEKQPVFMFCQAIIFSYPSTHPFILILGNKKLKQIFLSVLRHVRYWVKDRSLRLHRFTRGALCVF

SEQ ID NO: 219 - DNA, 960 bp, homo sapiens
  CDS (1)..(960)
  variation (521)..(521): SNP
  variation (577)..(577): SNP
  variation (756)..(756): SNP
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccgttcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaatttggggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctag

SEQ ID NO: 220 - protein, 319 aa, homo sapiens
MITFLPIIFSILIVVIFVIGNFANGFIALVNSIEWVKRQKISFVDQILTALAVSRVGLLWVLLLHWYATQLNPAFYSVEVRITAYNVWAVTNHFSSWLATSLSMFYLLRIANFSNLIFLRIKRRVKSVVLVILLGPLLFLVCHLFVINMDETVWTKEYEGNVTWKIKLRSAMYRSNMTLTMLANFVPLTLTLISFLLLICSLCKHLKKMQLHGKGSQDPSTKVHIKALQTVTSFLLLCAIYFLSMIISVCNLGRLEKQPVFMFCQAIIFSYPSTHPFILILGNKKLKQIFLSVLRHVRYWVKDRSLRLHRFTRGALCVF

SEQ ID NO: 221 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacatgctga

SEQ ID NO: 222 - protein, 299 aa, homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTC

SEQ ID NO: 223 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctga

SEQ ID NO: 224 - protein, 299 aa, homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 225 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatctttcattccactcattcatcctgattatgggaagtaggaagctaaaacagacctttctttcagttttgtggcagatgacacgctga

SEQ ID NO: 226 - protein, 299 aa, homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYLSFHSFILIMGSRKLKQTFLSVLWQMTR

SEQ ID NO: 227 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactcttgcaatcatgtatccttcattccactcattcatcctgattatgggaagtaggaagctaaaacagacctttctttcagttttgtggcagatgacatgctga

SEQ ID NO: 228 - protein, 299 aa, homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTLAIMYPSFHSFILIMGSRKLKQTFLSVLWQMTC

SEQ ID NO: 229 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattcagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctga

SEQ ID NO: 230 - protein, 299 aa, homo sapiens
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIQSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 231 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatgtcattgactgggttaacaaacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatctttcattccactcattcatcctgattatgggaagtaggaagctaaaacagacctttctttcagttttgtggcagatgacacgctga

SEQ ID NO: 232 - protein, 299 aa, homo sapiens
MMCFLLIISSILVVFAFVLGNVANGFIALVNVIDWVNKRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYLSFHSFILIMGSRKLKQTFLSVLWQMTR

SEQ ID NO: 233 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatatcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctga

SEQ ID NO: 234 - protein, 299 aa, homo sapiens
MMCFLLIISSILVVFAFVLGNVANGFIALVNIIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 235 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatatcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccacttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctga

SEQ ID NO: 236 - protein, 299 aa, homo sapiens
MMCFLLIISSILVVFAFVLGNVANGFIALVNIIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFATYFLCIITSTWNLRTQQSKLVLLLCQTVAIMYPSFHSFILIMGSRKLKQTFLSVLWQMTR

SEQ ID NO: 237 - DNA, 900 bp, homo sapiens
  CDS (1)..(900)
  variation (94)..(94): SNP
  variation (113)..(113): SNP
  variation (376)..(376): SNP
  variation (456)..(456): SNP
  variation (673)..(673): SNP
  variation (719)..(719): SNP
  variation (799)..(799): SNP
  variation (815)..(815): SNP
  variation (895)..(895): SNP
atgatgtgttttctgctcatcatttcatcaattctggtagtgtttgcatttgttcttggaaatgttgccaatggcttcatagccctagtaaatatcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagtgtgtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatgtaaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctga

SEQ ID NO: 238 - protein, 299 aa, homo sapiens
MMCFLLIISSILVVFAFVLGNVANGFIALVNIIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDECVWTKEYEGNVTWKIKLRNAIHLSSLTVTTLANLIPFTLSLICFLLLICSLCKHLKKMRLHSKGSQDPSTKVHVKALQTVTSFLMLFAIYFLCIITSTWNLRTQQSKLVLLLCQTVAIMYPSFHSFILIMGSRKLKQTFLSVLWQMTR

SEQ ID NO: 239 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 240 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 241 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcgtatatccatcattccactcattcattctgatttgggggaacaagacgctaaagcagacctttctttcagttttgtggcaggtgacttgctgggcaaaaggacagaaccagtcaactccatag

SEQ ID NO: 242 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIVYPSFHSFILIWGNKTLKQTFLSVLWQVTCWAKGQNQSTP

SEQ ID NO: 243 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatacacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 244 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAIHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 245 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaaaacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 246 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLVCHLVMKNTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 247 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaacttgtgatgaaaaacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcgtattacttgccatttactttctgtgtctaatcatatcgttttggaattctaagatgctaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 248 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLVCQLVMKNTYINVWTEECEGNVTWKIKLRNAMHLSNLTVAMLANLIPFTLTLISFLLLIYSLCKHLKKMQLHGKGSQDPSTKIHIKALQTVTSFLVLLAIYFLCLIISFWNSKMLPKEIVLMLCQAFGIIYPSFHSFILIWGNKTLKQTFLSVLWQVTCWAKGQNQSTP

SEQ ID NO: 249 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttgatttgtcaacttgtgatgaaaaacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcgtattacttgccatttactttctgtgtctaatcatatcgttttggaattctaagatgctaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 250 - protein, 309 aa, homo sapiens
MMSFLHIVFSILVVVAFILGNFANGFIALINFIAWVKRQKISSADQIIAALAVSKVGLLWVILLHWYSTVLNPTSSNLKVIIFISNAWAVTNHFSIWLATSLSIFYLLKIVNFSRLIFHHLKRKAKSVVLVIVLGSLFFLICQLVMKNTYINVWTEECEGNVTWKIKLRNAMHLSNLTVAMLANLIPFTLTLISFLLLIYSLCKHLKKMQLHGKGSQDPSTKIHIKALQTVTSFLVLLAIYFLCLIISFWNSKMLPKEIVLMLCQAFGIIYPSFHSFILIWGNKTLKQTFLSVLWQVTCWAKGQNQSTP

SEQ ID NO: 251 - DNA, 930 bp, homo sapiens
  CDS (1)..(930)
  variation (235)..(235): SNP
  variation (421)..(421): SNP
  variation (429)..(429): SNP
  variation (442)..(442): SNP
  variation (516)..(516): SNP
  variation (706)..(706): SNP
  variation (755)..(755): SNP
  variation (764)..(764): SNP
  variation (808)..(808): SNP
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccaaagttggtttgctctgggtaatattattacattggtattcaactgtgttgaatccaacttcatctaatttagaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatag

SEQ ID NO: 252 - protein, 309 aa, homo sapiens
MMSFLHIVFSILVVVAFILGNFANGFIALINFIAWVKRQKISSADQIIAALAVSKVGLLWVILLHWYSTVLNPTSSNLEVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 253 - DNA, 900 bp, homo sapiens
  CDS (1)..(900)
  variation (155)..(155): SNP
  variation (181)..(181): SNP
  variation (608)..(608): SNP
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccagttgtcatggttagcaaggctgttggaaacatatatcttgcattcgactcattcatcctaatttggagaaccaagaagctaaaacacacctttcttttgattttgtgtcagattaggtgctga

SEQ ID NO: 254 - protein, 299 aa, homo sapiens
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLCKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 255 - DNA, 900 bp, homo sapiens; identical to SEQ ID NO: 43
  CDS (1)..(900)
  variation (155)..(155): SNP
  variation (181)..(181): SNP
  variation (608)..(608): SNP

SEQ ID NO: 256 - protein, 299 aa, homo sapiens; identical to SEQ ID NO: 44

SEQ ID NO: 257 - DNA, 900 bp, homo sapiens
  CDS (1)..(900)
  variation (155)..(155): SNP
  variation (181)..(181): SNP
  variation (608)..(608): SNP
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctggtcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccagttgtcatggttagcaaggctgttggaaacatatatcttgcattcgactcattcatcctaatttggagaaccaagaagctaaaacacacctttcttttgattttgtgtcagattaggtgctga

SEQ ID NO: 258 - protein, 299 aa, homo sapiens
MITFLYIFFSILIMVLFVLGNFANGFIALVNFIDWVKRKKISSADQILTALAVSRIGLLWSLLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLCKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 259 - DNA, 900 bp, homo sapiens
  CDS (1)..(900)
  variation (155)..(155): SNP
  variation (181)..(181): SNP
  variation (608)..(608): SNP
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggtggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtataaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccagttgtcatggttagcaaggctgttggaaacatatatcttgcattcgactcattcatcctaatttggagaaccaagaagctaaaacacacctttcttttgattttgtgtcagattaggtgctga

SEQ ID NO: 260 - protein, 299 aa, homo sapiens
MITFLYIFFSILIMVLFVLGNFANGFIALVNFIDWVKRKKISSADQILTALVVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLYKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 261 - DNA, 957 bp, homo sapiens
  CDS (1)..(957)
  variation (595)..(595): SNP
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaaatgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgtcgttcctcaaggtgtgggacaccttga

SEQ ID NO: 262 - protein, 318 aa, homo sapiens
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKMITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 263 - DNA, 957 bp, homo sapiens
  CDS (1)..(957)
  variation (595)..(595): SNP
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaattgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgtcgttcctcaaggtgtgggacaccttga

SEQ ID NO: 264 - protein, 318 aa, homo sapiens
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKLITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

The invention claimed is:

1. An isolated T2R43 variant-specific nucleic acid molecule comprising at least about 10 contiguous nucleotides, spanning at least one single nucleotide polymorphism (SNP) selected from G at position 460; G at position 510; T at position 599; C at position 883; and G at position 889 of SEQ ID NO: 31.

2. An array, comprising the nucleic acid molecule of claim 1.

3. The array of claim 2, further comprising at least one nucleic acid molecule comprising at least about 10 contiguous nucleotides selected from T2R1, T2R3, T2R4, T2R5, T2R7, T2R8, T2R9, T2R10, T2R13, T2R14, T2R16, T2R38, T2R39, T2R40, T2R41, T2R43, T2R44, T2R45, T2R46, T2R47, T2R48, T2R49, T2R50, and T2R60, and spanning at least one SNP selected from the group consisting of: C/T at position 128 (SEQ ID NO: 1); A/G at position 332 (SEQ ID NO: 1); G/A at position 422 (SEQ ID NO: 1); C/T at position 616 (SEQ ID NO: 1); C/T at position 675 (SEQ ID NO: 1); T/C at position 850 (SEQ ID NO: 1); C/T at position 349 (SEQ ID NO: 3); C/T at position 807 (SEQ ID NO: 3); C/T at position 852 (SEQ ID NO: 3); G/A at position 8 (SEQ ID NO: 5); G/C at position 9 (SEQ ID NO: 5); A/C at position 17 (SEQ ID NO: 5); T/C at position 20 (SEQ ID NO: 5); T/A at position 186 (SEQ ID NO: 5); C/T at position 221 (SEQ ID NO: 5); G/C at position 286 (SEQ ID NO: 5); G/A at position 512 (SEQ ID NO: 5); G/A at position 571 (SEQ ID NO: 5); G/A at position 58 (SEQ ID NO: 7); G/T at position 77 (SEQ ID NO: 7); C/T at position 235 (SEQ ID NO: 7); C/T at position 338 (SEQ ID NO: 7); G/A at position 363 (SEQ ID NO: 7); G/A at position 500 (SEQ ID NO: 7); G/A at position 638 (SEQ ID NO: 7); G/T at position 881 (SEQ ID NO: 7); A/T at position 787 (SEQ ID NO: 9); C/T at position 788 (SEQ ID NO: 9); C/A at position 828 (SEQ ID NO: 9); G/A at position 912 (SEQ ID NO: 9); A/G at position 496 (SEQ ID NO: 11); G/A at position 549 (SEQ ID NO: 11); T/C at position 829 (SEQ ID NO: 11); G/A at position 922 (SEQ ID NO: 11); C/A at position 201 (SEQ ID NO: 13); T/A at position 450 (SEQ ID NO: 13); T/C at position 560 (SEQ ID NO: 13); G/T at position 867 (SEQ ID NO: 13); C/A at position 880 (SEQ ID NO: 13); C/T at position 910 (SEQ ID NO: 13); C/T at position 926 (SEQ ID NO: 13); A/G at position 120 (SEQ ID NO: 15); C/T at position 467 (SEQ ID NO: 15); A/C at position 521 (SEQ ID NO: 15); A/G at position 564 (SEQ ID NO: 15); G/A at position 627 (SEQ ID NO: 15); A/G at position (SEQ ID NO: 17); A/G at position 256 (SEQ ID NO: 19); G/A at position 375 (SEQ ID NO: 19); C/T at position 300 (SEQ ID NO: 21); G/A at position 301 (SEQ ID NO: 21); G/C at position 303 (SEQ ID NO: 21); T/C at position 460 (SEQ ID NO: 21); T/G at position 516 (SEQ ID NO: 21); G/A at position 665 (SEQ ID NO: 21); G/A at position 846 (SEQ ID NO: 21); C/G at position 145 (SEQ ID NO: 23); G/A at position 239 (SEQ ID NO: 23); C/T at position 785 (SEQ ID NO: 23); C/T at position 820 (SEQ ID NO: 23); G/A at position 886 (SEQ ID NO: 23); C/T at position 578 (SEQ ID NO: 25); G/A at position 589 (SEQ ID NO: 25); G/A at position 874 (SEQ ID NO: 25); C/A at position 560 (SEQ ID NO: 27); G/A at position 817 of T2R40 (SEQ ID NO: 27); G/A at position 189 (SEQ ID NO: 29); C/T at position 380 (SEQ ID NO: 29); T/A at position 584 (SEQ ID NO: 29); G/C at position 104 (SEQ ID NO: 31); G/A at position 270 (SEQ ID NO: 31); G/C at position 460 (SEQ ID NO: 31); T/G at position 510 (SEQ ID NO: 31); G/T at position 599 (SEQ ID NO: 31); G/A at position 635 (SEQ ID NO: 31); C/G at position 663 (SEQ ID NO: 31); T/G at position 882 (SEQ ID NO: 31); T/C at position 883 (SEQ ID NO: 31); A/G at position 889 (SEQ ID NO: 31); C/T at position 103 (SEQ ID NO: 33); T/C at position 423 (SEQ ID NO: 33); T/A at position 484 (SEQ ID NO: 33); G/A at position 599 (SEQ ID NO: 33); C/G at position 649 (SEQ ID NO: 33); C/T at position 680 (SEQ ID NO: 33); G/A at position 718 (SEQ ID NO: 33); A/G at position 744 (SEQ ID NO: 33); C/G at position 827 (SEQ ID NO: 33); G/A at position 843 (SEQ ID NO: 33); T/C at position 106 (SEQ ID NO: 35); T/A at position 682 (SEQ ID NO: 35); G/A at position 749 (SEQ ID NO: 35); C/T at position 862 (SEQ ID NO: 35); G/A at position 934 (SEQ ID NO: 37); G/A at position 920 (SEQ ID NO: 37); T/G at position 842 (SEQ ID NO: 37); T/G at position 756 (SEQ ID NO: 37); C/T at position 84 (SEQ ID NO: 39); G/A at position 94 (SEQ ID NO: 39); A/C at position 326 (SEQ ID NO: 39); T/C at position 418 (SEQ ID NO: 39); A/T at position 456 (SEQ ID NO: 39); A/G at position 673 (SEQ ID NO: 39); T/C at position 719 (SEQ ID NO: 39); G/C at position 799 (SEQ ID NO: 39); G/A at position 885 (SEQ ID NO: 39); C/T at position 895 (SEQ ID NO: 39); A/G at position 156 (SEQ ID NO: 41); C/T at position 261 (SEQ ID NO: 41); G/A at position 421 (SEQ ID NO: 41); C/A at position 429 (SEQ ID NO: 41); C/A at position 442 (SEQ ID NO: 41); G/A at position 516 (SEQ ID NO: 41); A/G at position 706 (SEQ ID NO: 41); T/C at position 755 (SEQ ID NO: 41); G/T at position 764 (SEQ ID NO: 41); A/C at position 808 (SEQ ID NO: 41); G/A at position 608 (SEQ ID NO: 43); A/T at position 595 (SEQ ID NO: 45); and C/T at position 930 of T2R60 (SEQ ID NO: 45).

4. The array of claim 2, further comprising at least one oligonucleotide from each T2R haplotype/allele selected from T2R1 (SEQ ID NO: 47), T2R3 (SEQ ID NO: 53), T2R4 (SEQ ID NO: 61), T2R5 (SEQ ID NO: 73), T2R7 (SEQ ID NO: 87), T2R8 (SEQ ID NO: 97), T2R9 (SEQ ID NO: 109), T2R10 (SEQ ID NO: 131), T2R13 (SEQ ID NO: 133), T2R14 (SEQ ID NO: 137), T2R16 (SEQ ID NO: 145), T2R38 (SEQ ID NO: 165), T2R39 (SEQ ID NO: 167), T2R40 (SEQ ID NO: 171), T2R41 (SEQ ID NO: 185), T2R44 (SEQ ID NO: 193), T2R46 (SEQ ID NO: 207), T2R47 (SEQ ID NO: 215), T2R48 (SEQ ID NO: 223), T2R49 (SEQ ID NO: 239), T2R50 (SEQ ID NO: 255) and T2R60 (SEQ ID NO: 261).

5. The array of claim 2, which array is a microarray.

6. A collection of two or more isolated T2R variant-specific nucleic acid molecules, each comprising at least about 10 contiguous nucleotides spanning at least one T2R SNP position selected from the group consisting of: position 332 of T2R1 (SEQ ID NO: 47); position 616 of T2R1 (SEQ ID NO: 47); position 349 of T2R3 (SEQ ID NO: 53); position 8 of T2R4 (SEQ ID NO: 61); position 17 of T2R4 (SEQ ID NO: 61); position 20 of T2R4 (SEQ ID NO: 61); position 186 of T2R4 (SEQ ID NO: 61); position 221 of T2R4 (SEQ ID NO: 61); position 268 of T2R4 (SEQ ID NO: 61); position 512 of T2R4 (SEQ ID NO: 61); position 77 of T2R5 (SEQ ID NO: 73); position 235 of T2R5 (SEQ ID NO: 73); position 338 of T2R5 (SEQ ID NO: 73); position 500 of T2R5 (SEQ ID NO: 73); position 638 of T2R5 (SEQ ID NO: 73); position 881 of T2R5 (SEQ ID NO: 73); position 254 of T2R7 (SEQ ID NO: 87); position 538 of T2R7 (SEQ ID NO: 87); position 640 of T2R7 (SEQ ID NO: 87); position 787 of T2R7 (SEQ ID NO: 87); position 788 of T2R7 (SEQ ID NO: 87); position 912 of T2R7 (SEQ ID NO: 87); position 142 of T2R8 (SEQ ID NO: 97); position 370 of T2R8 (SEQ ID NO: 97); position 496 of T2R8 (SEQ ID NO: 97); position 829 of T2R8 (SEQ ID NO: 97); position 922 of T2R8 (SEQ ID NO: 97); position 201 of T2R9 (SEQ ID NO: 109); position 381 of T2R9 (SEQ ID NO: 109); position 450 of T2R9 (SEQ ID NO: 109); position 560 of T2R9 (SEQ ID NO: 109); position 697 of T2R9 (SEQ ID NO: 109); position 867 of T2R9 (SEQ ID NO: 109); position 880 of T2R9 (SEQ ID NO: 109); position 467 of T2R10 (SEQ ID NO: 131); position 521 of T2R10 (SEQ ID NO: 131); position 691 of T2R10 (SEQ ID NO: 131); position 776 of T2R13 (SEQ ID NO: 133); position 256 of T2R14 (SEQ ID NO: 137); position 589 of T2R14 (SEQ ID NO: 137); position 301 of T2R16 (SEQ ID NO: 145); position 481 of T2R16 (SEQ ID NO: 145); position 516 of T2R16 (SEQ ID NO: 145); position 665 of T2R16 (SEQ ID NO: 145); position 145 of T2R38 (SEQ ID NO: 165); position 239 of T2R38 (SEQ ID NO: 165); position 785 of T2R38 (SEQ ID NO: 165); position 820 of T2R38 (SEQ ID NO: 165); position 886 of T2R38 (SEQ ID NO: 165); position 578 of T2R39 (SEQ ID NO: 167); position 589 of T2R39 (SEQ ID NO: 167); position 560 of T2R40 (SEQ ID NO: 171); position 817 of T2R40 (SEQ ID NO: 171); position 871 of T2R40 (SEQ ID NO: 171); position 380 of T2R41 (SEQ ID NO: 185); position 584 of T2R41 (SEQ ID NO: 185); position 103 of T2R44 (SEQ ID NO: 193); position 484 of T2R44 (SEQ ID NO: 193); position 599 of T2R44 (SEQ ID NO: 193); position 649 of T2R44 (SEQ ID NO: 193); position 656 of T2R44 (SEQ ID NO: 193); position 680 of T2R44 (SEQ ID NO: 193); position 718 of T2R44 (SEQ ID NO: 193); position 827 of T2R44 (SEQ ID NO: 193); position 843 of T2R44 (SEQ ID NO: 193); position 106 of T2R46 (SEQ ID NO: 207); position 682 of T2R46 (SEQ ID NO: 207); position 749 of T2R46 (SEQ ID NO: 207); position 834 of T2R46 (SEQ ID NO: 207); position 862 of T2R46 (SEQ ID NO: 207); position 521 of T2R47 (SEQ ID NO: 215); position 577 of T2R47 (SEQ ID NO: 215); position 756 of T2R47 (SEQ ID NO: 215); position 94 of T2R48 (SEQ ID NO: 223); position 113 of T2R48 (SEQ ID NO: 223); position 376 of T2R48 (SEQ ID NO: 223); position 456 of T2R48 (SEQ ID NO: 223); position 673 of T2R48 (SEQ ID NO: 223); position 719 of T2R48 (SEQ ID NO: 223); position 799 of T2R48 (SEQ ID NO: 223); position 815 of T2R48 (SEQ ID NO: 223); position 895 of T2R48 (SEQ ID NO: 223); position 235 of T2R49 (SEQ ID NO: 239); position 421 of T2R49 (SEQ ID NO: 239); position 429 of T2R49 (SEQ ID NO: 239); position 442 of T2R49 (SEQ ID NO: 239); position 516 of T2R49 (SEQ ID NO: 239); position 706 of T2R49 (SEQ ID NO: 239); position 755 of T2R49 (SEQ ID NO: 239); position 764 of T2R49 (SEQ ID NO: 239); position 808 of T2R49 (SEQ ID NO: 239); position 155 of T2R50 (SEQ ID NO: 255); position 181 of T2R50 (SEQ ID NO: 255); position 608 of T2R50 (SEQ ID NO: 255); and position 595 of T2R60 (SEQ ID NO: 261), wherein at least one of the nucleic acid molecules is a T2R43 variant-specific nucleic acid molecule spanning a SNP selected from G at position 460; G at position 510; T at position 599; C at position 883; and G at position 889 of SEQ ID NO: 31.

7. The collection of claim 6, comprising at least one isolated T2R variant-specific nucleic acid molecule selected from T2R1, T2R3, T2R4, T2R5, T2R7, T2R8, T2R9, T2R10, T2R13, T2R14, T2R16, T2R38, T2R39, T2R40, T2R41, T2R44, T2R46, T2R47, T2R48, T2R49, T2R50, and T2R60.

8. The collection of claim 6, comprising at least one isolated T2R variant-specific nucleic acid molecule from each of: position 332 of T2R1 (SEQ ID NO: 47); position 616 of T2R1 (SEQ ID NO: 47); position 349 of T2R3 (SEQ ID NO: 53); position 8 of T2R4 (SEQ ID NO: 61); position 17 of T2R4 (SEQ ID NO: 61); position 20 of T2R4 (SEQ ID NO: 61); position 186 of T2R4 (SEQ ID NO: 61); position 221 of T2R4 (SEQ ID NO: 61); position 268 of T2R4 (SEQ ID NO: 61); position 512 of T2R4 (SEQ ID NO: 61); position 77 of T2R5 (SEQ ID NO: 73); position 235 of T2R5 (SEQ ID NO: 73); position 338 of T2R5 (SEQ ID NO: 73); position 500 of T2R5 (SEQ ID NO: 73); position 638 of T2R5 (SEQ ID NO: 73); position 881 of T2R5 (SEQ ID NO: 73); position 254 of T2R7 (SEQ ID NO: 87); position 538 of T2R7 (SEQ ID NO: 87); position 640 of T2R7 (SEQ ID NO: 87); position 787 of T2R7 (SEQ ID NO: 87); position 788 of T2R7 (SEQ ID NO: 87); position 912 of T2R7 (SEQ ID NO: 87); position 142 of T2R8 (SEQ ID NO: 97); position 370 of T2R8 (SEQ ID NO: 97); position 496 of T2R8 (SEQ ID NO: 97); position 829 of T2R8 (SEQ ID NO: 97); position 922 of T2R8 (SEQ ID NO: 97); position 201 of T2R9 (SEQ ID NO: 109); position 381 of T2R9 (SEQ ID NO: 109); position 450 of T2R9 (SEQ ID NO: 109); position 560 of T2R9 (SEQ ID NO: 109); position 697 of T2R9 (SEQ ID NO: 109); position 867 of T2R9 (SEQ ID NO: 109); position 880 of T2R9 (SEQ ID NO: 109); position 467 of T2R10 (SEQ ID NO: 131); position 521 of T2R10 (SEQ ID NO: 131); position 691 of T2R10 (SEQ ID NO: 131); position 776 of T2R13 (SEQ ID NO: 133); position 256 of T2R14 (SEQ ID NO: 137); position 589 of T2R14 (SEQ ID NO: 137); position 301 of T2R16 (SEQ ID NO: 145); position 481 of T2R16 (SEQ ID NO: 145); position 516 of T2R16 (SEQ ID NO: 145); position 665 of T2R16 (SEQ ID NO: 145); position 145 of T2R38 (SEQ ID NO: 165); position 239 of T2R38 (SEQ ID NO: 165); position 785 of T2R38 (SEQ ID NO: 165); position 820 of T2R38 (SEQ ID NO: 165); position 886 of T2R38 (SEQ ID NO: 165); position 578 of T2R39 (SEQ ID NO: 167); position 589 of T2R39 (SEQ ID NO: 167); position 560 of T2R40 (SEQ ID NO: 171); position 817 of T2R40 (SEQ ID NO: 171); position 871 of T2R40 (SEQ ID NO: 171); position 380 of T2R41 (SEQ ID NO: 185); position 584 of T2R41 (SEQ ID NO: 185); position 103 of T2R44 (SEQ ID NO: 193); position 484 of T2R44 (SEQ ID NO: 193); position 599 of T2R44 (SEQ ID NO: 193); position 649 of T2R44 (SEQ ID NO: 193); position 656 of T2R44 (SEQ ID NO: 193); position 680 of T2R44 (SEQ ID NO: 193); position 718 of T2R44 (SEQ ID NO: 193); position 827 of T2R44 (SEQ ID NO: 193); position 843 of T2R44 (SEQ ID NO: 193); position 106 of T2R46 (SEQ ID NO: 207); position 682 of T2R46 (SEQ ID NO: 207); position 749 of T2R46 (SEQ ID NO: 207); position 834 of T2R46 (SEQ ID NO: 207); position 862 of T2R46 (SEQ ID NO: 207); position 521 of T2R47 (SEQ ID NO: 215); position 577 of T2R47 (SEQ ID NO: 215); position 756 of T2R47 (SEQ ID NO: 215); position 94 of T2R48 (SEQ ID NO: 223); position 113 of T2R48 (SEQ ID NO: 223); position 376 of T2R48 (SEQ ID NO: 223); position 456 of T2R48 (SEQ ID NO: 223); position 673 of T2R48 (SEQ ID NO: 223); position 719 of T2R48 (SEQ ID NO: 223); position 799 of T2R48 (SEQ ID NO: 223); position 815 of T2R48 (SEQ ID NO: 223); position 895 of T2R48 (SEQ ID NO: 223); position 235 of T2R49 (SEQ ID NO: 239); position 421 of T2R49 (SEQ ID NO: 239); position 429 of T2R49 (SEQ ID NO: 239); position 442 of T2R49 (SEQ ID NO: 239); position 516 of T2R49 (SEQ ID NO: 239); position 706 of T2R49 (SEQ ID NO: 239); position 755 of T2R49 (SEQ ID NO: 239); position 764 of T2R49 (SEQ ID NO: 239); position 808 of T2R49 (SEQ ID NO: 239); position 155 of T2R50 (SEQ ID NO: 255); position 181 of T2R50 (SEQ ID NO: 255); position 608 of T2R50 (SEQ ID NO: 255); and position 595 of T2R60 (SEQ ID NO: 261).

9. The collection of claim 6, further comprising at least one isolated T2R variant-specific nucleic acid molecule from each of SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259 and 263.

10. The collection of claim 9, wherein the isolated T2R variant-specific nucleic acid molecules comprise the sequence as shown in SEQ ID NO: 49, 55, 57, 59, 63, 65, 67, 69, 71, 75, 77, 79, 81, 83, 85, 89, 91, 93, 95, 99, 101, 103, 105, 107, 111, 113, 115, 117, 119, 121, 123, 125, 127, 129, 135, 139, 141, 147, 149, 151, 155, 157, 161, 163, 169, 173, 175, 177, 179, 181, 183, 187, 189, 191, 197, 199, 201, 203, 205, 209, 211, 213, 217, 219, 225, 227, 229, 231, 233, 235, 237, 241, 243, 245, 247, 249, 251, 253, 257, 259 and 263.

11. The collection of claim 6, wherein each nucleic acid molecule is stored in a separate container.

12. The collection of claim 11, wherein the separate containers are wells of a microtiter plate or equivalent thereof.

13. The collection of claim 6, wherein the nucleic acid molecules of the collection are affixed to a solid surface in an array.

14. The collection of claim 13, wherein the array is a microarray.

15. The collection of claim 14, which comprises nucleic acid molecules having the sequence as set forth in SEQ ID NO: 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, or 263.

16. The collection of claim 6, wherein the isolated T2R variant-specific nucleic acid molecules comprise:
 (a) SEQ ID NOs: 47, 49, and 51;
 (b) SEQ ID NOs: 53 and 55;
 (c) SEQ ID NOs: 57, 59, 61, 63, 65, 67, 69, and 71;
 (d) SEQ ID NOs: 73, 75, 77, 79, 81, 83, and 85;
 (e) SEQ ID NOs: 87, 89, 91, 93, and 95;
 (f) SEQ ID NOs: 97, 99, 101, 103, 105, and 107;
 (g) SEQ ID NOs: 109, 111, 113, 115, 117, 119, 121, and 123;
 (h) SEQ ID NOs: 125, 127, 129, and 131;
 (i) SEQ ID NOs: 133 and 135;
 (j) SEQ ID NOs: 137, 139, and 141;
 (k) SEQ ID NOs: 143, 145, 147, 149, and 151;
 (l) SEQ ID NOs: 153, 155, 157, 159, 161, 163, and 165;
 (m) SEQ ID NOs: 167 and 169;
 (n) SEQ ID NOs: 171, 173, 175, and 179;
 (o) SEQ ID NOs: 181, 183, and 185;
 (p) SEQ ID NOs: 187, 189, 191, 193, 195, 197, and 199;
 (q) SEQ ID NOs: 201, 203, 205, 207, 209, and 211;
 (r) SEQ ID NOs: 213, 215, 217, and 219;
 (s) SEQ ID NOs: 221, 223, 225, 227, 229, 231, 233, 235, and 237;
 (t) SEQ ID NOs: 239, 241, 243, 245, 247, 249 and 251;
 (u) SEQ ID NOs: 253, 255, 257, and 259;
 (v) SEQ ID NOs: 261 and 263; or
 (w) a combination of two or more of (a) through (v).

17. A vector comprising the isolated nucleic acid molecule of claim 1.

18. An isolated host cell comprising the vector of claim 17.

* * * * *